United States Patent
Ambrose et al.

(10) Patent No.: US 10,212,944 B2
(45) Date of Patent: Feb. 26, 2019

(54) DESIGNED COMPLEX ENDOPHYTE COMPOSITIONS AND METHODS FOR IMPROVED PLANT TRAITS

(71) Applicant: Indigo Agriculture, Inc., Cambridge, MA (US)

(72) Inventors: Karen V. Ambrose, Cambridge, MA (US); Brett A. Boghigian, Boston, MA (US); Slavica Djonovic, Malden, MA (US); Paul Andrew Gray, Arlington, MA (US); Gerardo V. Toledo, Belmont, MA (US); Luis Miguel Marquez, Belmont, MA (US); Julianne Naomi Pelaez, Cambridge, MA (US); Geoffrey von Maltzahn, Boston, MA (US)

(73) Assignee: Indigo Agriculture, Inc., Boston, MA (US)

( * ) Notice: Subject to any disclaimer, the term of this patent is extended or adjusted under 35 U.S.C. 154(b) by 0 days.

(21) Appl. No.: 15/143,394

(22) Filed: Apr. 29, 2016

(65) Prior Publication Data
US 2016/0366892 A1      Dec. 22, 2016

Related U.S. Application Data

(60) Provisional application No. 62/156,006, filed on May 1, 2015.

(51) Int. Cl.
*A01N 63/00* (2006.01)
*A01N 63/04* (2006.01)
(Continued)

(52) U.S. Cl.
CPC ............ *A01N 63/04* (2013.01); *A01H 17/00* (2013.01); *A01N 63/00* (2013.01); *C12N 1/14* (2013.01); *C12N 1/20* (2013.01); *A01G 22/00* (2018.02)

(58) Field of Classification Search
CPC ...................................................... A01N 63/00
See application file for complete search history.

(56) References Cited

U.S. PATENT DOCUMENTS

| 4,940,834 A | 7/1990 | Hurley et al. |
| 5,041,290 A | 8/1991 | Gindrat et al. |

(Continued)

FOREIGN PATENT DOCUMENTS

| CA | 1041788 | 11/1978 |
| CA | 1229497 | 11/1987 |

(Continued)

OTHER PUBLICATIONS

Result 11 from a search in the GenEmbl database, GenEmbl Record No. EU 977189, Smith et al., "Bioactive endophytes warrant intensified exploration and conservation," PLoS ONE 3(8):E3052, 2008.*

(Continued)

*Primary Examiner* — Rosanne Kosson
(74) *Attorney, Agent, or Firm* — Fenwick & West LLP

(57) ABSTRACT

This invention relates to methods and materials for providing a benefit to a plant by associating the plant with a complex endophyte comprising a host fungus further comprising a component bacterium, including benefits to a plant derived from a seed or other plant element treated with a complex endophyte. For example, this invention provides purified complex endophytes, purified complex endophyte components such as bacteria or fungi, synthetic combina- (Continued)

Designed Complex Endophyte 15776+EHB166 tions comprising said complex endophytes and/or components, and methods of making and using the same.

39 Claims, 13 Drawing Sheets

Specification includes a Sequence Listing.

(51) Int. Cl.
*A01H 17/00* (2006.01)
*C12N 1/14* (2006.01)
*C12N 1/20* (2006.01)
*A01G 22/00* (2018.01)

(56) References Cited

U.S. PATENT DOCUMENTS

| | | |
|---|---|---|
| 5,113,619 A | 5/1992 | Leps et al. |
| 5,229,291 A | 7/1993 | Nielsen et al. |
| 5,292,507 A | 3/1994 | Charley |
| 5,415,672 A | 5/1995 | Fahey et al. |
| 5,730,973 A | 3/1998 | Morales et al. |
| 5,919,447 A | 7/1999 | Marrone et al. |
| 5,994,117 A | 11/1999 | Bacon et al. |
| 6,072,107 A | 6/2000 | Latch et al. |
| 6,077,505 A | 6/2000 | Parke et al. |
| 6,337,431 B1 | 1/2002 | Tricoli et al. |
| 6,495,133 B1 | 12/2002 | Xue |
| 6,681,186 B1 | 1/2004 | Denisov et al. |
| 6,689,880 B2 | 2/2004 | Chen et al. |
| 6,823,623 B2 | 11/2004 | Minato et al. |
| 7,037,879 B2 | 5/2006 | Imada et al. |
| 7,084,331 B2 | 8/2006 | Isawa et al. |
| 7,335,816 B2 | 2/2008 | Kraus et al. |
| 7,341,868 B2 | 3/2008 | Chopade et al. |
| 7,485,451 B2 | 2/2009 | VanderGheynst et al. |
| 7,555,990 B2 | 7/2009 | Beaujot |
| 7,632,985 B2 | 12/2009 | Malven et al. |
| 7,763,420 B2 | 7/2010 | Stritzker et al. |
| 7,906,313 B2 | 3/2011 | Henson et al. |
| 7,977,550 B2 | 7/2011 | West et al. |
| 8,143,045 B2 | 3/2012 | Miansnikov et al. |
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 9,113,636 B2 | 1/2015 | von Maltzahn et al. |
| 8,975,489 B2 | 3/2015 | Craven |
| 9,277,751 B2 | 3/2016 | Sword |
| 9,288,995 B2 | 3/2016 | von Maltzahn et al. |
| 9,295,263 B2 | 3/2016 | von Maltzahn et al. |
| 9,364,005 B2 | 6/2016 | Mitter et al. |
| 9,408,394 B2 | 8/2016 | von Maltzahn et al. |
| 9,532,572 B2 | 1/2017 | von Maltzahn et al. |
| 9,532,573 B2 | 1/2017 | von Maltzahn et al. |
| 9,545,111 B2 | 1/2017 | Sword |
| 9,622,485 B2 | 4/2017 | von Maltzahn et al. |
| 9,687,001 B2 | 6/2017 | Vujanovic et al. |
| 9,756,865 B2 | 9/2017 | Sword |
| 2005/0072047 A1 | 4/2005 | Conkling et al. |
| 2006/0046246 A1 | 3/2006 | Zeng et al. |
| 2007/0028318 A1 | 2/2007 | Livore et al. |
| 2007/0055456 A1 | 3/2007 | Raftery et al. |
| 2007/0142226 A1 | 6/2007 | Franco |
| 2007/0292953 A1 | 12/2007 | Mankin et al. |
| 2008/0229441 A1 | 9/2008 | Young et al. |
| 2008/0289060 A1 | 11/2008 | De Beuckeleer et al. |
| 2009/0155214 A1 | 6/2009 | Isawa et al. |
| 2010/0064392 A1 | 3/2010 | Yang et al. |
| 2010/0095396 A1 | 4/2010 | Voeste et al. |
| 2010/0205690 A1 | 8/2010 | Blasing et al. |
| 2010/0227357 A1 | 9/2010 | Redman et al. |
| 2011/0182862 A1 | 7/2011 | Green et al. |
| 2012/0108431 A1 | 5/2012 | Williams et al. |
| 2012/0131696 A1 | 5/2012 | Aayal et al. |
| 2012/0144533 A1 | 6/2012 | Craven |
| 2012/0149571 A1 | 6/2012 | Kloepper et al. |
| 2012/0178624 A1 | 7/2012 | Kaminskyj et al. |
| 2012/0324599 A1 | 12/2012 | Kerns et al. |
| 2013/0031673 A1 | 1/2013 | Grandlic et al. |
| 2013/0071425 A1 | 3/2013 | Vidal et al. |
| 2013/0079225 A1 | 3/2013 | Smith et al. |
| 2013/0150240 A1 | 6/2013 | Newman et al. |
| 2013/0233501 A1 | 9/2013 | Van Zyl et al. |
| 2014/0020136 A1 | 1/2014 | Van Der Wolf et al. |
| 2014/0109249 A1* | 4/2014 | Turner .................... A01H 1/04 800/260 |
| 2014/0115731 A1 | 4/2014 | Turner et al. |
| 2014/0147425 A1 | 5/2014 | Henn et al. |
| 2014/0342905 A1 | 11/2014 | Bullis et al. |
| 2015/0020239 A1 | 1/2015 | von Maltzahn et al. |
| 2015/0033420 A1 | 1/2015 | Rodriguez et al. |
| 2015/0126365 A1 | 5/2015 | Sword |
| 2015/0230478 A1 | 8/2015 | Vujanovic et al. |
| 2015/0335029 A1 | 11/2015 | Mitter et al. |
| 2015/0366217 A1 | 12/2015 | Vujanovic et al. |
| 2015/0368607 A1 | 12/2015 | Arnold et al. |
| 2015/0373993 A1 | 12/2015 | von Maltzahn et al. |
| 2016/0150796 A1 | 6/2016 | von Maltzahn et al. |
| 2016/0174570 A1 | 6/2016 | Vujanovic et al. |
| 2016/0192662 A1 | 7/2016 | Sword |
| 2016/0205947 A1 | 7/2016 | Sword |
| 2016/0235074 A1 | 8/2016 | von Maltzahn et al. |
| 2016/0255844 A1 | 9/2016 | Mitter et al. |
| 2016/0286821 A1 | 10/2016 | Sword |
| 2016/0316760 A1 | 11/2016 | Ambrose et al. |
| 2016/0316763 A1 | 11/2016 | Sword |
| 2016/0330976 A1 | 11/2016 | Mitter et al. |
| 2016/0338360 A1 | 11/2016 | Mitter et al. |
| 2017/0020138 A1 | 1/2017 | von Maltzahn et al. |
| 2017/0164619 A1 | 6/2017 | von Maltzahn et al. |
| 2017/0164620 A1 | 6/2017 | von Maltzahn et al. |
| 2017/0215358 A1 | 8/2017 | Franco et al. |
| 2017/0223967 A1 | 8/2017 | Mitter et al. |
| 2018/0020677 A1 | 1/2018 | Ambrose et al. |
| 2018/0092365 A1 | 4/2018 | Sword |
| 2018/0153174 A1 | 6/2018 | Riley et al. |

FOREIGN PATENT DOCUMENTS

| | | |
|---|---|---|
| CA | 2562175 | 1/2013 |
| CN | 1604732 | 4/2005 |
| CN | 101311262 A | 11/2008 |
| CN | 101570738 | 11/2009 |
| CN | 102168022 A | 8/2011 |
| CN | 102010835 B | 4/2012 |
| CN | 102533601 B | 10/2013 |
| CN | 103642725 A | 3/2014 |
| CN | 104560742 A | 1/2015 |
| EP | 0192342 | 8/1986 |
| EP | 0223662 | 5/1987 |
| EP | 0378000 | 7/1990 |
| EP | 0494802 | 7/1992 |
| EP | 0818135 | 1/1998 |
| EP | 1935245 | 6/2008 |
| EP | 2676536 | 12/2013 |
| JP | 2009/072168 | 4/2009 |
| KR | 20100114806 A | 10/2010 |
| KR | 101091151 | 12/2011 |
| KR | 20130023491 | 3/2013 |
| WO | WO 1988/009114 | 1/1988 |
| WO | WO 1994/016076 | 7/1994 |
| WO | WO 2000/029607 | 5/2000 |
| WO | WO 2001/083818 | 11/2001 |
| WO | WO 2002/065836 | 8/2002 |
| WO | WO 2005/003328 | 1/2005 |
| WO | WO 2007/021200 | 2/2007 |
| WO | WO 2007/107000 | 9/2007 |
| WO | WO 2008/103422 | 8/2008 |
| WO | WO 2009/012480 A2 | 1/2009 |
| WO | WO 2009/078710 A1 | 6/2009 |
| WO | WO 2009/126473 A1 | 10/2009 |
| WO | WO 2010/109436 | 9/2010 |
| WO | WO 2010/115156 | 10/2010 |

(56) References Cited

FOREIGN PATENT DOCUMENTS

| | | |
|---|---|---|
| WO | WO 2011/001127 | 1/2011 |
| WO | WO 2011/082455 | 7/2011 |
| WO | WO 2011/112781 | 9/2011 |
| WO | WO 2011/117351 | 9/2011 |
| WO | WO 2012/034996 | 3/2012 |
| WO | WO 2013/016361 | 1/2013 |
| WO | WO 2013/029112 | 3/2013 |
| WO | WO 2013/090628 | 6/2013 |
| WO | WO 2013/122473 | 8/2013 |
| WO | WO 2013/177615 | 12/2013 |
| WO | WO 2013/190082 | 12/2013 |
| WO | WO 2014/046553 | 3/2014 |
| WO | WO 2014/082950 | 6/2014 |
| WO | WO 2014/121366 | 8/2014 |
| WO | WO 2014/206953 | 12/2014 |
| WO | WO 2014/210372 | 12/2014 |
| WO | WO 2015/035099 | 3/2015 |
| WO | WO 2015/069938 | 5/2015 |
| WO | WO 2015/100431 | 7/2015 |
| WO | WO 2015/100432 | 7/2015 |
| WO | WO 2015/200852 | 12/2015 |
| WO | WO 2015/200902 | 12/2015 |
| WO | WO 2016/109758 | 7/2016 |
| WO | WO 2016/179046 | 11/2016 |
| WO | WO 2016/179047 | 11/2016 |
| WO | WO 2016/200987 | 12/2016 |

OTHER PUBLICATIONS

Result 3 from a search in the GenEmbl database, GenEmbl Record No. KF011597, Paenibacillus strain No. HA13, Park et al., "Isolation and characterization of humic substances-degrading bacteria from the subarctic Alaska grasslands," J Basic Microbiol, 2013.*
Kusari et al., "Chemical ecology of endophytic fungi: origins of secondary metabolites," Cell Press, Chem & Biol, 19:792-798, 2012.*
PCT International Search Report and Written Opinion, Application No. PCT/AU2014/000360, dated Aug. 5, 2015, 12 Pages.
PCT International Search Report and Written Opinion, PCT Application No. PCT/US2015/068206, dated Jun. 27, 2016, 20 Pages.
PCT International Search Report and Written Opinion, PCT Application No. PCT/US2016/030292, dated Aug. 12, 2016, 20 Pages.
PCT International Preliminary Report on Patentability, PCT Application No. PCT/US2016/030292, dated Aug. 2, 2017, 23 Pages.
PCT International Search Report and Written Opinion, PCT Application No. PCT/US2016/030293, dated Aug. 11, 2016, 23 Pages.
PCT International Search Report and Written Opinion, PCT Application No. PCT/US2016/036504, dated Nov. 4, 2016, 18 Pages.
PCT International Search Report and Written Opinion, PCT Application No. PCT/US2016/039191, dated Nov. 29, 2016, 20 Pages.
PCT International Search Report and Written Opinion, PCT Application No. PCT/US2016/068144, dated May 18, 2017, 30 Pages.
Canadian Patent Office, Office Action, Canadian Patent Application No. CA 2,953,466, dated Dec. 11, 2017, 7 Pages.
Canadian Patent Office, Office Action, Canadian Patent Application No. 2,916,678, dated Feb. 8, 2017, 8 Pages.
Canadian Patent Office, Office Action, Canadian Patent Application No. 2,935,218, dated Jun. 13, 2017, 5 Pages.
Canadian Patent Office, Office Action, Canadian Patent Application No. CA 2,953,697, dated Oct. 12, 2017, 6 Pages.
Canadian Patent Office, Office Action, Canadian Patent Application No. CA 2,952,057, dated Oct. 12, 2017, 4 Pages.
Canadian Patent Office, Office Action, Canadian Patent Application No. CA 2,929,487, dated Dec. 7, 2017, 4 Pages.
Chinese Patent Office, Office Action, Chinese Patent Application No. 201480072142.7, dated Apr. 25, 2017, 14 Pages (with English translation).
Chinese Patent Office, 2nd Office Action for Chinese Patent Application No. CN 201480072142.7, dated Oct. 30, 2017, 13 Pages, (with English translation).

European Patent Office, Supplementary Partial European Search Report, European Patent Application No. 13874703.5, dated Jun. 21, 2016, 3 Pages.
European Patent Office, Supplementary European Search Report, European Patent Application No. 13874703.5, dated Oct. 21, 2016, 16 Pages.
European Patent Office, Communication Pursuant to Article 94(3) EPC for European Patent Application No. 13874703.5, dated Jan. 5, 2018, 4 Pages.
European Patent Office, Supplementary European Search Report, European Patent Application No. 14860187.5, dated May 24, 2017, 9 Pages.
European Patent Office, Supplementary European Search Report, European Patent Application No. 14874589.6, dated Jul. 11, 2017, 9 Pages.
European Patent Office, Examination Report, European Patent Application No. 14748326.7, dated Jul. 19, 2017, 4 Pages.
European Patent Office, Examination Report for European Patent Application No. EP 14777213.1, dated Oct. 20, 2017, 12 Pages.
European Patent Office, Supplementary European Search Report, European Patent Application No. EP 15809264.3, dated Dec. 4, 2017, 16 Pages.
European Patent Office, Communication Pursuant to Article 94(3) EPC for European Patent Application No. 15810847.2, dated Nov. 17, 2017, 17 Pages.
European Patent Office, Supplementary European Search Report, European Patent Application No. EP 15812324.0, dated Nov. 2, 2017, 19 Pages.
Intellectual Property Australia, Examination Report for Australian Patent Application No. 2014346664, dated Nov. 24, 2016, 3 Pages.
Intellectual Property Australia, Examination Report for Australian Patent Application No. 2014315191, dated Jul. 15, 2017, 6 Pages.
Intellectual Property Australia, Examination Report for Australian Patent Application No. 2015279600, dated Jul. 21, 2017, 7 Pages.
Intellectual Property Australia, Examination Report for Australian Patent Application No. 2015278238, dated Jul. 24, 2017, 3 Pages.
Intellectual Property Australia, Examination Report No. 1 for Australian Patent Application No. AU 2017254880, dated Nov. 15, 2017, 2 Pages.
New Zealand Intellectual Property Office, First Examination Report, New Zealand Patent Application No. 715728, dated Dec. 5, 2016, 3 Pages.
New Zealand Intellectual Property Office, First Examination Report, New Zealand Patent Application No. 727449, dated Jun. 8, 2017, 7 Pages.
New Zealand Intellectual Property Office, First Examination Report, New Zealand Patent Application No. 726116, dated Jun. 29, 2017, 2 Pages.
New Zealand Intellectual Property Office, First Examination Report, New Zealand Patent Application No. 726116, dated Sep. 26, 2017, 5 Pages.
New Zealand Intellectual Property Office, First Examination Report, New Zealand Patent Application No. 728495, dated Jul. 12, 2017, 5 Pages.
New Zealand Intellectual Property Office, First Examination Report for New Zealand Patent Application No. NZ 728483, dated Dec. 8, 2017, 2 Pages.
Russian Patent Office, Office Action for Russian Patent Application No. RU 2017127214, dated Nov. 22, 2017, 4 Pages, (with English translation).
Russian Patent Office, Office Action for Russian Patent Application No. RU 2015137613, dated Jun. 7, 2017, 14 Pages (with English translation).
Ukraine Patent Office, Office Action for Ukrainian Patent Application No. a201508515, dated May 19, 2017, 14 Pages (with English translation).
Abdou, R., et al., "Botryorhodines A-D, antifungal and cytotoxic depsidones from Botryosphaeria rhodina, an endophyte of the medicinal plant *Bidens pilosa*," Phytochemistry, 2010, vol. 71, pp. 110-116.
Adhikari, M., et al., "A New Record of Pseudeurotium bakeri from Crop Field Soil in Korea," The Korean Journal of Mycology, 2016, pp. 145-149, vol. 44.

(56) References Cited

OTHER PUBLICATIONS

Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.
Bensch, K., et al., "Species and ecological diversity within the Cladosporium cladosporioides complex (Davidiellaceae, Capnodiales)," Studies in Mycology, 2010, pp. 1-94, vol. 67.
Buttner, D., et al., "Regulation and secretion of Xanthomonas virulence factors," FEMS Microbiology Reviews, 2010, pp. 107-133, vol. 34, No. 2.
Chagas, F., et al., "A Mixed Culture of Endophytic Fungi Increases Production of Antifungal Polyketides," J. Chem Ecol., Oct. 2013, pp. 1335-1342, vol. 39.
Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.
Cottyn, B., et al., "Phenotypic and genetic diversity of rice seed-associated bacteria and their role in pathogenicity and biological control," Journal of Applied Microbiology, 2009, pp. 885-897, vol. 107.
Darsonval, A., et al., "Adhesion and Fitness in the Bean Phyllosphere and Transmission to Seed of Xanthomonas fuscans subsp. fuscans," Molecular Plant-Microbe Interactions, 2009, pp. 747-757, vol. 22, No. 6.
Darsonval, A., et al., "The Type III Secretion System of Xanthomonas fuscans subsp. fuscans is involved in the Phyllosphere Colonization Process and in Transmission to Seeds of Susceptible Beans," Applied and Envioronmental Mirobiology, 2008, pp. 2669-2678, vol. 74, No. 9.
Dbget, "Orthology: K14454," 2005, 2 pages, can be retrieved at <URL:http://www.genome.jp/dbget-bin/www_bget?ko:K14454>.
Gebhardt, J., et al., "Characterization of a single soybean cDNA encoding cytosolic and glyoxysomal isozymes of aspartate aminostransferase," Plant Molecular Biology, 1998, pp. 99-108, vol. 37.
GenBank: AF034210.1 "Glycine max aspartate aminotransferase glyoxysomal isozyme AAT1 precursor and aspartate aminotransferase cytosolic isozyme AAT2 (AAT) mRNA, complete cds," NCBI, May 26, 1998, 2 Pages, can be retrieved at <URL:https://www.ncbi.nlm.nih.gov/nuccore/AF034210>.
GenBank: JN210900.1, "Enterobacter sp. WS05 16S ribosomal RNA gene, partial sequence," NCBI, Sep. 24, 2012, 1 Page, can be retrieved at <URL:https://www.ncbi.nlm.nih.gov/nuccore/jn210900>.
GenBank: NP_001237541.1, "aspartate aminotransferase glyoxysomal isozyme AAT1 precursor [Glycine max]," NCBI, Oct. 29, 2016, 2 Pages, can be retrieved at <URL:https://www.ncbi.nlm.nih.gov/protein/NP_001237541.1>.
GenEmbl Database, GenEmbl Record No. KF673660, Sandberg, et al., "Fungal endophytes of aquatic macrophytes: diverse host-generalists characterized by tissue preferences and geographic structure," 2013, 35 Pages.
GenEmbl Database, GenEmbl Record No. KP991588, Huang, et al., "Pervasive effects of wildfire on foliar endophyte communities in montane forest trees," Mar. 2015, 35 Pages.
GenEmbl Database, GenEmbl Record No. JN872548, 38 Pages, Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
Giraldo, A., et al., "Phylogeny of Sarocladium (Hypocreales)," Persoonia, 2015, pp. 10-24, vol. 34.
Grondona, I., et al., "TUSAL®, a commercial biocontrol formulation based on Trichoderma," Bulletin OILB/SROP, 2004, pp. 285-288, vol. 27, No. 8.
Hahm, M-S., et al., "Biological Control and Plant Growth Promoting Capacity of Rhizobacteria and Pepper Under Greenhouse and Field Conditions," The Journal of Microbiology, The Microbiological Society of Korea, Heidelberg, Jun. 30, 2012, pp. 380-385, vol. 50, No. 3.
Hanson, L.E., "Reduction of Verticillium Wilt Symptoms in Cotton Following Seed Treatment with Trichoderma virens," The Journal of Cotton Science, 2000, pp. 224-231, vol. 4, No. 4.
Hanson, L.E., "Reduction of Verticillium Wilt Symptoms in Cotton Following Seed Treatment with Trichoderma virens," Proceedings Beltwide Cotton Conferences, 2000, vol. 1. (Abstract), 1 Page.
Harman, G.E., et al., "Symposium: biocontrol and biotechnological methods for controlling cotton pests," Proceedings of the Beltwide Cotton Production Research Conf., 1989, Memphis, Tennessee, USA, pp. 15-20. (Abstract).
Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.
Khan, A.L., et al., "Salinity Stress Resistance Offered by Endophytic Fungal Interaction Between Penicillium miniolutuem LHL09 and Glycine max. L," J. Microbiol. Biotechnol., 2011, pp. 893-902, vol. 21, No. 9.
Kuklinsky-Sobral, J., et al., "Isolation and characterization of soybean-associated bacteria and their potential for plant growth promotion," Environmental Microbiology, 2004, pp. 1244-1251, vol. 6, No. 12.
Labeda, D.P., et al., "Phylogenetic study of the species within the family Streptomycetaceae," Antonie van Leeuwenhoek, 2012, vol. 101, pp. 73-104, Springer.
Le, X.H., et al., "Effects of endophytic Streptomyces on the lucerne (Medicago sativa L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.
Le, X.H., et al., "Isolation and characterisation of endophytic actinobacteria and their effect on the early growth and nodulation of lucerne (Medicago sativa L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.
Lehman, S.G., "Treat Cotton Seed," Review of Applied Mycology, 1945, 24, 369, 16 Pages.
Lehman, S.G., "Treat Cotton Seed," Research and Farming III, Progr. Rept., 1945, 3, 5, 16 Pages.
Li, H., et al., "Endophytes and their role in phytoremediation," Fungal Diversity, 2012, pp. 11-18, vol. 54.
Mehnaz, S., et al., "Isolation and 16S rRNA sequence analysis of the beneficial bacteria from the rhizosphere of rice," Canada Journal of Microbiology, 2001, pp. 110-117, vol. 47, No. 2.
Mei, C., et al., "The Use of Beneficial Microbial Endophytes for Plant Biomass and Stress Tolerance Improvement," Recent Patents on Biotechnology, 2010, pp. 81-95, vol. 4.
Misk, A., et al., "Biocontrol of chickpea root rot using endophytic actinobacteria", Biocontrol, vol. 56, No. 5, Mar. 12, 2011, pp. 811-822, XP036215297.
Nimnoi, P., et al., "Co-Inoculation of Soybean (Glycin max) with Actinomycetes and Bradyrhizobium Japonicum Enhances Plant Growth, Nitrogenase Activity and Plant Nutrition," Journal of Plant Nutrition, 2014, pp. 432-446, vol. 37.
Op De Beeck, M., et al., "Comparison and Validation of Some ITS Primer Pairs Useful for Fungal Metabarcoding Studies," PLOS ONE, Jun. 2014, vol. 9, Issue 6, e97629, pp. 1-11.
Philrice Batac, Philippine Rice R&D Highlights, 2012, Area-Based R&D Projects, 52 Pages, [online][Retrieved Aug. 11, 2016] Retrieved from the Internet <URL:http://www.philrice.gov.ph/2012-rd-highlights/>.
Rasmussen, S., et al., "Grass-endophyte interactions: a note on the role of monosaccharide transport in the Neotyphodium lolii-Lolium perenne symbiosis," New Phytologist, 2012, pp. 7-12, vol. 196.
Riken, GI No. GMFL01-01-D03, 2 Pages, [online] [Retrieved on Dec. 18, 2017] Retrieved from the Internet <URL:http://spectra.psc.riken.jp/menta.cgi/rsoy/datail?id=GMFL01-01-D03>.
Senthilkumar, M., et al., "Biocontrol Potential of Soybean Bacterial Endophytes Against Charcoal Rot Fungus, Rhizoctonia batatiola," Current Microbiology, 2009, vol. 58, pp. 288-293.

(56) References Cited

OTHER PUBLICATIONS

Sessitsch, A., et al., "*Burkholderia phytofirmans* sp. Nov., a novel plant-associated bacterium with plant-beneficial properties," International Journal of Systematic and Evoluntary Microbiology, 2005, pp. 1187-1192, vol. 55.
Shankar, M., et al.,"Root colonization of a rice growth promoting strain of Enterobacter cloacae," Journal of Basic Microbiology, 2011, pp. 523-530, vol. 51.
Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.
Soe, K.M., et al., "Low-Density Co-Inoculation of Myanmar Bradyrhizobium yuanmingense MAS34 and Streptomyces griseoflavus P4 to Enhance Symbiosis and Seed Yield in Soybean Varieties," American Journal of Plant Sciences, 2013, pp. 1879-1892, vol. 4.
Sogonov, M.V., et al., "The hyphomycete *Teberdinia hygrophila* gen. nov., sp. nov. and related anamorphs of *Pseudeurotium* species," Mycologia, May 2005, pp. 695-709, vol. 97, No. 3.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in Spodoptera litura (Lepidoptera: Noctuidae) Larvae by Endophytic Fungi Nigrospora oryzae and Cladosporium uredinicola,", Annals of the Entomological Society of America, May 1, 2014, pp. 674-679, vol. 107, No. 3.
Trichoderma definition, 2016, 6 Pages, [online] [Retrieved on Sep. 16, 2016,] Retrieved from the Internet <URL:https://en.wikipedia.org/wiki/Trichoderma>.
Verkley, G., et al., "*Paraconiothyrium*, a new genus to accommodate the mycoparasite Coniothyrium minitans, anamorphs of Paraphaeosphaeria, and four new species," Studies in Mycology, 2004, pp. 323-335, vol. 50.
Visagie, C.M., et al., "Identification and nomenclature of the genus *Penicillium*," Studies in Mycology, Jun. 2014, pp. 343-371, vol. 78.
Wang, B., et al., "Fungal endophytes of native *Gossypium* species in Australia," Mycological Research, 2007, pp. 347-354, vol. 111, No. 3.
Waqas, M., et al., "Endophytic Fungi Produce Gibberellins and Indoleacetic Acid and Promotes Host-Plant Growth during Stress," Molecules, 2012, pp. 10754-10773, vol. 17.
Weindling, R., "Relation of dosage to control of cotton seedling diseases by seed treatment," Plant Disease Reporter, 1943, 27, pp. 68-70.
Yandigeri, M. S., et al., "Drought-tolerant endophytic actinobacteria promote growth of wheat (*Triticum aestivum*) under water stress conditions," Plant Growth Regulation, 2012, pp. 411-420, vol. 68.
Zhang, J., et al: "Isolation and Characterization of Plant Growth-Promoting Rhizobacteria from Wheat Roots by Wheat Germ Agglutinin Labeled with Fluorescein Isothiocyanate", The Journal of Microbiology, Apr. 27, 2012, vol. 50, No. 2, pp. 191-198, GenBank Accession No. JN210900.
Zhao, J.H., et al., "Bioactive secondary metabolites from *Nigrospora* sp. LLGLM003, an endophytic fungus of the medicinal plant *Moringa oleifera* Lam." World Journal of Microbiology and Biotechnology, Kluwer Academic Publishers, Feb. 12, 2012, pp. 2107-2112, vol. 28, No. 5.
Garazzino, S., et al., "Osteomyelitis Caused by Enterobacter cancerogenus Infection following a Traumatic Injury: Case Report and Review of the Literature," J Clin Microbiol., Mar. 2005, vol. 43, No. 3, pp. 1459-1461.
Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.

Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.
Humann, J., et al., "Complete genome of the onion pathogen *Enterobacter cloacae* EcWSU1," Standard in Genomic Sciences, Dec. 31, 2011, vol. 5, No. 3, pp. 279-286.
Jung, C., et al., "The Effects of Endohyphal Bacteria on Anti-Cancer and Anti-Malaria Metabolites of Endophytic Fungi," Honors Thesis, University of Arizona, May 2012, 15 Pages.
Kim, M., et al., "Towards a taxonomic coherence between average nucleotide identity and 16S rRNA gene sequence similarity for species demarcation of prokaryotes", Int J Systematic Evolutionary Microbial., 2014, vol. 64, pp. 346-351.
Kumar, S., et al., "MEGA7: Molecular Evolutionary Genetics Analysis version 7.0 for bigger datasets," Molecular Biology and Evolution, Mar. 22, 2016, vol. 33, pp. 1870-1874.
Nishijima, K.A., et al., "Demonstrating Pathogenicity of Enterobacter cloacae on Macadamia and Identifying Associated Volatiles of Gray Kernel of Macadamia in Hawaii," Plant Disease, Oct. 2007, vol. 91, No. 10, pp. 1221-1228.
Ren, Y., et al., "Complete Genome Sequence of *Enterobacter cloacae* subsp. *cloacae* Type Strain ATCC 13047," J. Bacteriol. May 2010, vol. 192, No. 9, pp. 2463-2464.
Tamura, K., et al., "Estimation of the number of nucleotide substitutions in the control region of mitochondrial DNA in humans and chimpanzees," Molecular Biology and Evolution, 1993, vol. 10, No. 3, pp. 512-526.
Yennamalli, R., et al., "Endoglucanases: insights into thermostability for biofuel applications", Biotech Biofuels, 2013, vol. 6, Issue 136, pp. 1-9.
PCT Invitation to Pay Additional Fees, PCT Application No. PCT/US2017/064351, dated Feb. 9, 2018, 18 Pages.
PCT International Search Report and Written Opinion, PCT Application No. PCT/US2017/064351, dated Apr. 9, 2018, 25 Pages.
PCT Invitation to Pay Additional Fees, PCT Application No. PCT/US2017/064361, dated Mar. 7, 2018, 18 Pages.
PCT International Search Report and Written Opinion for PCT/US2017/064361, dated May 11, 2018, 22 Pages.
PCT Invitation to Pay Additional Fees, PCT Application No. PCT/US2017/064292, dated Mar. 5, 2018, 15 Pages.
PCT International Search Report and Written Opinion, PCT Application No. PCT/US2017/064292, dated May 11, 2018, 20 Pages.
PCT International Search Report and Written Opinion, PCT Application No. PCT/US2017/068255, dated Mar. 19, 2018, 14 Pages.
Canadian Patent Office, Office Action, Canadian Patent Application No. 2,935,218, dated May 8, 2018, 5 Pages.
European Patent Office, Communication Pursuant to Article 94(3) EPC for European Patent Application No. EP 14748326.7, dated Feb. 15, 2018, 7 Pages.
European Patent Office, Supplementary European Search Report for European Patent Application No. 15810847.2, dated Feb. 28, 2018, 19 Pages.
European Patent Office, Extended European Search Report, European Patent Application No. EP 15812324.0, dated Feb. 21, 2018, 23 Pages.
European Patent Office, Extended European Search Report, European Patent Application No. EP 15809264.3, dated Mar. 12, 2018, 14 Pages.
European Patent Office, Extended European Search Report, European Patent Application No. EP 15876324.3, dated Jun. 12, 2018, 9 Pages.
Intellectual Property Australia, Examination Report No. 1 for Australian Patent Application No. AU 2017201009, dated Apr. 4, 2018, 3 Pages.
Intellectual Property Australia, Examination Report No. 1 for Australian Patent Application No. AU 2017210482, dated May 15, 2018, 4 Pages.
New Zealand Intellectual Property Office, Further Examination Report, New Zealand Patent Application No. 726116, dated Feb. 27, 2018, 6 Pages.
Russian Patent Office, Office Action for Russian Patent Application No. RU 2017141758, dated Apr. 17, 2018, 4 Pages (with Concise Explanation of Relevance).

(56) References Cited

OTHER PUBLICATIONS

Russian Patent Office, Office Action for Russian Patent Application No. RU 2017141632, dated Apr. 17, 2018, 4 Pages (with Concise Explanation of Relevance).

Ukraine Patent Office, Office Action for Ukrainian Patent Application No. a201508515, dated Feb. 20, 2018, 9 Pages (with English translation).

Office Action for Israel Patent Application No. IL 255682, dated Mar. 15, 2018, 2 Pages (Translation).

Office Action for Israel Patent Application No. IL 255684, dated Mar. 19, 2018, 2 Pages (Translation).

Office Action for Israel Patent Application No. IL 255685, dated Mar. 20, 2018, 2 Pages (Translation).

Office Action for Israel Patent Application No. IL 255688, dated Mar. 22, 2018, 2 Pages (Translation).

Office Action for Israel Patent Application No. IL 245385, dated Mar. 23, 2018, 3 Pages (With Concise Explanation of Relevance).

Abdellatif, L., et al., "Characterization of virulence and PCR-DGGE profiles of Fusarium avenaceum from western Canadian Prairie Ecozone of Saskatchewan," Canadian Journal of Plant Pathology, 2010, pp. 468-480.

Abou-Shanab, R. A., et al: "Characterization of Ni-resistant bacteria in the rhizosphere of the hyperaccumulator Alyssum murale by 16S rRNA gene sequence analysis", World Journal of Microbiology and Biotechnology, vol. 26, No. 1, Aug. 15, 2009, pp. 101-108.

Amatuzzi, R.F., et al., "Universidade Federal Do Parana," Jan. 1, 2014, 52 Pages. (With English Abstract).

Amatuzzi, R.F., et al., "Potential of endophytic fungi as biocontrol agents of Duponchelia fovealis (Zeller) (Lepidoptera: Crambidae," Brazilian Journal of Biology, Nov. 9, 2017, 7 Pages.

Aveskamp, M., et al., "DNA phylogeny reveals polyphyly of Phoma section Peyronellaea and multiple taxonomic novelties," Mycologia, 2009, vol. 101, No. 3, pp. 363-382.

Bethlenfalvay, G., et al., "Mycorrhizal fungi effects on nutrient composition and yield of soybean seeds", Journal of Plant Nutrition, vol. 20, No. 4-5, Apr. 1, 1997, pp. 581-591.

Bing, LA, et al., "Suppression of Ostrinia nubilalis (Hübner) (Lepidoptera: Pyralidae) by endophytic Beauveria bassiana (Balsamo) Vuillemin", Environmental Entomol, Entomological Society of America, College Park, MD, US, vol. 20, Jan. 1, 1991, pp. 1207-1211.

Compant, S., et al., "Endophytic colonization of *Vitis vinfera* L. By Burkholderia phytofirmans strain PsJN: from the rhizosphere to inflorescence tissues," FEMS Microbiol Ecol, 2008, pp. 84-93, vol. 63.

NCBI GenBank: CP000653.1 "*Enterobacter* sp. 638, complete genome" Jan. 28, 2014, 5 Pages, Can be retrieved at <URL:https://www.ncbi.nlm.nih.gov/nuccore/CP000653.1>.

NCBI GenBank: CP000653.1 "*Enterobacter* sp. 638, complete genome" ASM1632v1, Apr. 18, 2007, 2 Pages, Can be retrieved at <URL:https://www.ncbi.nlm.nih.gov/assembly/GCA_000016325.1>.

NCBI GenBank: EU340965.1 "*Enterobacter* sp. 638 16S ribosomal RNA gene, partial sequence" Jan. 30, 2009, 1 Page, Can be retrieved at <URL:https://www.ncbi.nlm.nih.gov/nuccore/EU340965.1>.

NCBI GenBank: EBI accession No. EM STD:JQ759988, "*Dothideomycetes* sp. genotype 226 isolate FL0175 internal transcribed spacer 1, partial sequence; 5.85 ribosomal RNA gene and internal transcribed spacer 2, complete sequence; and 28S ribosomal RNA gene, partial sequence," May 17, 2012, 2 Pages.

NCBI GenBank: EBI accession No. EM STD:GU055658, "Uncultured Periconia clone NG R 806 18S ribosomal RNA gene, partial sequence; internal transcribed spacer 1, 5.8S ribosomal RNA gene, and internal transcribed spacer 2, complete sequence; and 28S ribosomal RNA gene, partial sequence," Oct. 27, 2009, 2 Pages.

Database Geneseq Database accession No. BAP97938 "Pantoea dispersa strain KACC91642P 16S rDNA sequence, SEQ ID 1." Aug. 15, 2013, 1 Page.

Database EMBL [Online] Oct. 1, 2001, 2 Pages, "Setosphaeria monoceras 28S ribosomal RNA gene, partial sequence," XP002777918, retrieved from EBI accession No. EM_STD:AY016368 Database accession No. AY016368 sequence.

Hamayun, M., et al., "Cladosporium sphaerospermum as a new plant growth-promoting endophyte from the roots of *Glycine max* (L.) Merr," World Journal of Microbiology and Biotechnology, Kluwer Academic Publishers, Feb. 15, 2009, pp. 627-632, vol. 25, No. 4.

Hubbard, M., et al., "Agricultural Potential of Fungal Endophytes of Grasses, Cereals and Wheat," In: Wheat: Genetics, Crops and Food Production. Nova Science Publishers Hauppauge, NY, USA. 2011. pp. 333-345.

Impullitti, A.E., et al., "Fungal endophyte diversity in soybean", Journal of Applied Microbiolog, vol. 114, No. 5, May 1, 2013, pp. 1500-1506.

Klaubauf, S., et al., "Molecular diversity of fungal communities in agricultural soils from Lower Austria," Fungal Diversity, Aug. 13, 2010, pp. 65-75, vol. 44, No. 1.

Knapp, D., et al., "Inter- and intraspecific functional diversity of fungal root endophytes of semiarid sandy grasslands," Acta Microbiologica et Immunologica Hungarica, Nov. 2017, pp. 1-101, vol. 64, Supp. 1.

Kumar, A., et al., "Bio-control potential of *Cladosporium* sp. (MCPL-461), against a noxious weed *Parthenium hysterophorus* L.," J. Environ Biol., Mar. 2009, pp. 307-312, vol. 30, Issue 2.

Liu, Y., et al., "Phylogenetic relationships among ascomycetes: evidence from an RNA polymerase II subunit," Mol. Biol. Evol. 1999. vol. 16, No. 12, pp. 1799-1808.

Mandyam, K., et al., "Mutualism-parasitism paradigm synthesized from results of root-endophyte models", Frontiers in Microbiology, Jan. 12, 2015, pp. 1-14, vol. 5.

Miyoshi-Akiyama, T., et al., "Multilocus Sequence Typing (MLST) for Characterization of Enterobacter cloacae," PLoS ONE, 2013, vol. 8, No. 6, 10 Pages, e66358.

Nassar, A., et al., "Promotion of plant growth by an auxin-producing isolate of the yeast Williopsis saturnus endophytic in maize (*Zea mays* L.) roots", Biology and Fertility of Soils; Cooperating Journal of International Society of Soil Science, Springer, Berlin, DE, vol. 42, No. 2, Nov. 1, 2005, pp. 97-108.

O'Hanlon, K., et al., "Exploring the potential of symbiotic fungal endophytes in cereal disease suppression", Biological Control, vol. 63, No. 2, Sep. 5, 2012, pp. 69-78.

Rae, R., et al., "A subset of naturally isolated Bacillus strains show extreme virulence to the free-living nematodes *Caenorhabditis elegans* and *Pristionchus pacificus*", Environmental Microbiology, 2010, pp. 3007-3021, vol. 12, No. 11.

Riess, K., et al., "High genetic diversity at the regional scale and possible speciation in Sebacina epigaea and S. incrustans," BMC Evolutionary Biology, 2013, vol. 13, No. 102, 17 Pages.

Samways, M.J., et al., "Assessment of the Fungus *Cladosporium oxyspoum* (BERK. and CURT.) as a Potential BioControl Agent Against Certain Homoptera," Elsevier Science Publioshers B.V., Jan. 1, 1986, pp. 231-239.

Saunders, M., et al., "Host-Synthesized Secondary Compounds Influence the In Vitro Interactions between Fungal Endophytes of Maize", Applied and Environmental Microbiology, Nov. 9, 2007, pp. 136-142, vol. 74, No. 1.

Shiraishi, A., et al., "Nodulation in black locust by the ammaproteobacteria *Pseudomonas* sp. and the Betaproteobacteria *Burkholderia* sp", Systematic & Applied Microbiology, Aug. 2010, pp. 269-274, vol. 33, No. 5.

Simola, L., et al., "The Effect of Some Protein and Non-Protein Amino Acids on the Growth of Cladosporium herbarum and Trichotheeium roseum," Effect of Amino Acids on Fungi, Physiologia Plantarum, 1979, pp. 381-387, vol. 46.

Stielow, J.B., et al., "One fungus, which genes? Development and assessment of universal primers for potential secondary fungal DNA barcodes," Persoonia: Molecular Phylogeny and Evolution of Fungi, 2015, vol. 35, pp. 242-263.

Taghavi, S., et al., "Genome Sequence of the Plant Growth promoting Endophytic Bacterium *Enterobacter* sp. 638", PLoS Genet., May 2010, pp. 1-15, vol. 6, Issue 5, e1000943.

(56) References Cited

OTHER PUBLICATIONS

U'Ren, J.M., et al., "Host and geographic structure of endophytic and endolichenic fungi at the continental scale," American Journal of Botany, May 1, 2012, pp. 898-914, vol. 99, No. 5.

Valencia, E., et al., "Mini-review: Brazilian fungi diversity for biomass degradation," Fungal Genetics and Biology, 2013, pp. 9-18, vol. 60.

Vujanovic, V., et al., "Viability Testing of Orchid Seed and the Promotion of Colouration and Germination," Annals of Botany, Mar. 17, 2000, pp. 79-86, vol. 86.

Vujanovic, V., et al., "Endophytic hyphal compartmentalization is required for successful mycobiont-wheat interaction as revealed by confocal laser microscopy," The proceedings of the Soils and Crops conference in Saskatoon (2008) published 2009, 7 Pages.

Vujanovic, V., et al., "A comparative study of endophytic mycobiota in leaves of Acer saccharum in eastern North America," Mycological Progress, May 2002, pp. 147-154, vol. 1, Issue 2.

Vujanovic, V., et al.,"Orchid seed viability testing by fungal bioassays and molecular phylogeny," Floriculture, ornamental and plant biotechnology, 2006, vol. 63, pp. 563-569.

Vujanovic, V., et al., "Mycovitality—a new concept of plant biotechnology," Canadian Journal Plant Pathol, 2007, vol. 29, p. 451.

Vujanovic, V., et al., "19th International Conference on *Arabidopsis*. Research Proceedings—ICAR13," Jul. 23-27, 2008, 264 Pages, Montreal, QC, Canada.

Vujanovic, V., et al., "Mycovitality and mycoheterotrophy: where lies dormancy in terrestrial orchid and plants with minute seeds?" Symbiosis, 2007, vol. 44, pp. 93-99.

Vujanovic, V., et al., "Seed endosymbiosis: a vital relationship in providing prenatal care to plants," Can. J. Plant Sci., NRC Research Press, Feb. 6, 2017, pp. 972-981, vol. 97.

Vujanovic, V., et al: "Fungal communities associated with durum wheat production system: A characterization by growth stage, plant organ and preceding crop", Crop Protection, Elsevier Science, GB, vol. 37, Feb. 19, 2012, pp. 26-34.

Youssef, Y.A., et al., "Production of Plant Growth Substances by Rhizosphere Myoflora of Broad Bean and Cotton," Biologia Plantarum, 1975, pp. 175-181, vol. 17, No. 3.

Zhang, Y., et al., BcGsl, a glycoprotein from Botrytis cinerea, elicits defence response and improves disease resistance in host plants. Biochemical and biophysical research communications, Biochemical and Biophysical Research Communications, 2015, vol. 457, No. 4, pp. 627-634.

Zhang, W., et al., Host range of Exserohilum monoceras, a potential bioherbicide for the control of *Echinochloa* species, Canadian Journal of Botany/ Journal Canadien De Botan, National Research Council, Ottawa, CA, vol. 75, Jan. 1, 1997, pp. 685-692.

Zhu et al., *Helminthosporium velutinum* and *H. aquaticum* sp. nov. from aquatic habitats in Yunnan Province, China. Phytotaxa, 2016, vol. 253, No. 3, pp. 179-190.

Sarkar, S., et al., "New report of additional enterobacterial species causing wilt in West Bengal, India," Canadian Journal of Microbiology, 2015, vol. 61, No. 7, pp. 477-486.

NCBI GenBank: Accession No. JX880250.1, "Enterobacteriaceae bacterium Clero1 16S ribosomal RNA gene, partial sequence," NIH, Jun. 24, 2015, 2 Pages, can be retreived at <URL:https://www.ncbi.nlm.nih.gov/nucleotide/JX880250.1?report=genbank&log$=nuclalign&blast_rank=80&RID=KWUPBV08015>.

Azcon, R., et al., "Selective interactions between different species of mycorrhizal fungi and Rhizobium meliloti strains, and their effects on growth, $N_2$-fixation ($^{15}N$) and nutrition of *Medicago sativa* L.," New PhytoL., 1991, vol. 117, pp. 399-404.

Intellectual Property Australia, Examination Report No. 2 for Australian Patent Application No. AU 2014315191, dated Jul. 6, 2018, 3 Pages.

Intellectual Property Australia, Examination Report No. 2 for Australian Patent Application No. AU 2015279600, dated Jul. 6, 2018, 3 Pages.

Office Action for Mexican Patent Application No. MX/a/2015/010142, dated May 29, 2018, 5 Pages (With Concise Explanation of Relevance).

New Zealand Intellectual Property Office, Further Examination Report, New Zealand Patent Application No. 734085, dated Jun. 27, 2018, 6 Pages.

New Zealand Intellectual Property Office, Further Examination Report, New Zealand Patent Application No. 727449, dated Jun. 15, 2018, 5 Pages.

European Patent Office, Communication Pursuant to Article 94(3) EPC for European Patent Application No. EP 14777213.1, dated Jun. 18, 2018, 4 Pages.

Artursson, V., et al., "Interactions between arbuscular mycorrhizal fungi and bacteria and their potential for stimulating plant growth", Environmental Microbiology, vol. 8, No. 1, Jan. 1, 2006, pp. 1-10.

PCT Invitation to Pay Additional Fees, PCT Application No. PCT/CA2013/000091, dated Mar. 27, 2013, 2 Pages.

PCT International Search Report and Written Opinion for PCT/CA2013/000091, dated Sep. 20, 2013, 17 Pages.

PCT International Search Report and Written Opinion for PCT/EP2013/062976, dated Dec. 22, 2014, 9 Pages.

PCT International Search Report, Application No. PCT/US2014/044427, dated Dec. 3, 2014, 9 Pages.

PCT International Search Report and Written Opinion, Application No. PCT/US2014/054160, dated Dec. 9, 2014, 21 Pages.

PCT Invitation to Pay Additional Fees, PCT Application No. PCT/US2014/064411, dated Feb. 5, 2015, 2 Pages.

PCT International Search Report and Written Opinion, International Application No. PCT/US2014/064411, dated Mar. 27, 2015, 15 Pages.

PCT Invitation to Pay Additional Fees, PCT Application No. PCT/US2014/072399, dated Apr. 14, 2015, 2 Pages.

PCT International Search Report and Written Opinion, International Application No. PCT/US2014/072399, dated Jun. 26, 2015, 22 Pages.

PCT Invitation to Pay Additional Fees, PCT Application No. PCT/US2014/072400, dated Apr. 16, 2015, 6 Pages.

PCT International Search Report and Written Opinion, Application No. PCT/US2014/072400, dated Jul. 8, 2015, 38 Pages.

PCT Invitation to Pay Additional Fees, PCT Application No. PCT/US2015/038110, dated Sep. 22, 2015, 8 Pages.

PCT Invitation to Pay Additional Fees, PCT Application No. PCT/US2015/038187, dated Oct. 14, 2015, 5 Pages.

PCT International Search Report and Written Opinion, PCT Application No. PCT/US2015/038110, dated Dec. 11, 2015, 36 Pages.

PCT International Search Report and Written Opinion, PCT Application No. PCT/US2015/038187, dated Jan. 22, 2016, 36 Pages.

PCT Invitation to Pay Additional Fees, PCT Application No. PCT/US2015/068206, dated Apr. 12, 2016, 5 Pages.

Abarenkov, K., et al., "PlutoF—A Web Based Workbench for Ecological and Taxonomic Research, with an Online Implementation for Fungal ITS Sequences," Evol Bioinform Online, 2010, pp. 189-196, vol. 6.

Abarenkov, K., et al., "The UNITE Database for Molecular Identification of Fungi—Recent Updates and Future Perspectives," New Phytol., 2010, pp. 281-285, vol. 186.

Abdellatif, L., et al., "Endophytic hyphal compartmentalization is required for successful symbiotic Ascomycota association with root cells," Mycological Research, 2009, pp. 782-791, vol. 113.

Ahmad, F., et al., "Screening of Free-Living Rhizospheric Bacteria for Their Multiple Plant Growth Promoting Activities," Microbiol Res., 2008, pp. 173-181, vol. 163.

Amann, R., et al., "The Identification of Microorganisms by Fluorescence in Situ Hybridisation," Curr Opin Biotechnol., 2001, pp. 231-236, vol. 12.

Apel, K., et al., "Reactive Oxygen Species: Metabolism, Oxidative Stress, and Signal Transduction," Annu Rev Plant Biol., 2004, pp. 373-399, vol. 55.

Arendt, K. R., et al., "Isolation of endohyphal bacteria from foliar Ascomycota and in vitro establishment of their symbiotic associations," Appl. Environ. Microbiol., 2016, pp. 2943-2949, vol. 82, No. 10.

(56) References Cited

OTHER PUBLICATIONS

Bacon, C. W., et al., "Isolation, In Planta Detection, and Uses of Endophytic Bacteria for Plant Protection," Manual of Environmental Microbiology, 2007, pp. 638-647.

Baker, K. F., et al., "Dynamics of Seed Transmission of Plant Pathogens," Annu Rev Phytopathol., 1966, pp. 311-334,vol. 4.

Baltruschat, H., et al., "Salt tolerance of barley induced by the root endophyte Piriformospora indica is associated with a strong increase in antioxidants," New Phytologist., 2008, pp. 501-510, vol. 180.

Block, C. C., et al., "Seed Transmission of Pantoea stewartii in Field and Sweet Corn," Plant Disease, 1998, pp. 775-780, vol. 82.

Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.

Brodie, E.L., et al., "Uncultured Bacterium Clone BANW722 16S Ribosomal RNA Gene, Partial Sequence," NCBI GenBank Accession No. DQ264636, Submitted Oct. 25, 2005.

Bulgarelli, D., et al., "Structure and Functions of the Bacterial Microbiota of Plants," Annu Rev Plant Biol., 2013, pp. 807-838, vol. 64.

Caporaso, J.G., et al., "Ultra-High-Throughput Microbial Community Analysis on the Illumina HiSeq and MiSeq Platforms," ISME J., 2012, pp. 1621-1624, vol. 6.

Castillo, D., et al., "Fungal Entomopathogenic Endophytes: Negative Effects on Cotton Aphid Reproduction in Greenhouse and Field Conditions," Power Point Presentation dated Mar. 23, 2013.

Castillo, D., et al., "Fungal Endophytes: Plant Protective Agents Against Herbivores," Power Point Presentation dated Aug. 4, 2013.

Cavalier-Smith, T., "A Revised Six-Kingdom System of Life," Biol Rev Camb Philos Soc., 1998, pp. 203-266, vol. 73.

Cha, C., et al., "Production of Acyl-Homoserine Lactone Quorum-Sensing Signals by Gram-Negative Plant Associated Bacteria," Mol Plant Microbe Interact., 1998, pp. 1119-1129, vol. 11, No. 11.

Chernin, L. S., et al., "Chitinolytic Activity in Chromobacterium violaceum: Substrate Analysis and Regulation by Quorum Sensing," J Bacteriol., 1998, pp. 4435-4441, vol. 180, No. 17.

Clark, E. M., et al., "Improved Histochemical Techniques for the Detection of Acremonium coenophilum in Tall Fescue and Methods of in vitro Culture of the Fungus," J. Microbiol Methods, 1983, pp. 149-155, vol. 1.

Clay, K., "Effects of fungal endophytes on the seed and seedling biology of Lolium perenne and Festuca arundinacea," Oecologia, 1987, pp. 358-362, vol. 73.

Clough, S. J., et al., "Floral Dip: A Simplified Method for Agrobacterium-mediated Transformation of *Arabidopsis thaliana*," Plant J., 1998, pp. 735-743, vol. 16, No. 6.

Compant, S., et al., "Endophytes of Grapevines Flowers, Berries, and Seeds: Identification of Cultivable Bacteria, Comparison with Other Plant Parts, and Visualization of Niches of Colonization," Microbial Ecology, 2011, pp. 188-197, vol. 62.

Coombs, J. T., et al., "Isolation and Identification of Actinobacteria from Surface-Sterilized Wheat Roots," Applied and Environmental Microbiology, 2003, pp. 5603-5608, vol. 69, No. 9.

Conn, V. M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.

Cox, C. D., "Deferration of Laboratory Media and Assays for Ferric and Ferrous Ions," Methods Enzymol., 1994, pp. 315-329, vol. 235.

Craine, J. M., et al., "Global Diversity of Drought Tolerance and Grassland Climate-Change Resilience," Nature Climate Change, 2013, pp. 63-67, vol. 3.

Dalal, J.M., et al., "Utilization of Endophytic Microbes for Induction of Systemic Resistance (ISR) in Soybean (*Glycine max* (L) Merril) Against Challenge Inoculation with R. solani," Journal of Applied Science and Research, 2014, pp. 70-84, vol. 2, No. 5.

Danhorn, T., et al., "Biofilm Formation by Plant-Associated Bacteria," Annu Rev Microbiol., 2007, pp. 401-422, vol. 61.

Daniels, R., et al., "Quorum Signal Molecules as Biosurfactants Affecting Swarming in Rhizobium etli," PNAS, 2006, pp. 14965-14970, vol. 103, No. 40.

De Freitas, J. R., et al., "Phosphate-Solubilizing Rhizobacteria Enhance the Growth and Yield but not Phosphorus Uptake of Canola (*Brassica napus* L.)," Biol Fertil Soils, 1997, pp. 358-364, vol. 24.

De Lima Favaro, L. C., et al., "Epicoccum nigrum P16, a Sugarcane Endophyte, Produces Antifungal Compounds and Induces Root Growth," PLoS One, 2012, pp. 1-10, vol. 7, No. 6.

De Melo Pereira, G. V., et al. "A Multiphasic Approach for the Identification of Endophytic Bacterial in Strawberry Fruit and their Potential for Plant Growth Promotion," Microbial Ecology, 2012, pp. 405-417, vol. 63, No. 2.

De Souza, J. J., et al., "Terpenoids from Endophytic Fungi," Molecules, 2011, pp. 10604-10618, vol. 16, No. 12.

Dennis, C., et al., "Antagonistic Properties of Species Groups of Trichoderma," Trans Brit Mycol Soc, 1971, pp. 25-39, vol. 57, No. 1.

Desiro, A., et al., "Detection of a novel intracellular microbiome hosted in arbuscular mycorrhizal fungi," ISME Journal, 2014, pp. 257-270, vol. 8.

Djordjevic, D., et al., "Microtiter Plate Assay for Assessment of Listeria monocytogenes Biofilm Formation," Annl Environ Microbiol., 2002, pp. 2950-2958, vol. 68, No. 6.

Don, R. H., et al., "Properties of Six Pesticide Degradation Plasmids Isolated From Alcaligenes Paradoxus and Alcaligenes eutrophus," J Bacteriol., 1981, pp. 681-686, vol. 145, No. 2.

Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012.

Eberhard, A., et al., "Structural Identification of Autoinducer of Photobacterium fischeri Luciferase," Biochem., 1981, pp. 2444-2449, vol. 20.

Edgar, R. C., "Search and Clustering Orders of Magnitude Faster than BLAST," Bioinformatics, 2010, pp. 2460-2461, vol. 26, No. 19.

Edgar, R. C., "UPARSE: Highly Accurate OTU Sequences From Microbial Amplicon Reads," Nat Methods, 2013, pp. 996-998, vol. 10, No. 10.

Ek-Ramos, M. J., "Ecology, Distribution and Benefits of Fungal Endophytes Isolated from Cultivated Cotton (*Gossypium hirsutum*) in Texas," Power Point Presentation dated Nov. 7, 2012.

Ek-Ramos, M. J., et al., "Spatial and Temporal Variation in Fungal Endophyte Communities Isolated from Cultivated Cotton (*Gossypium hirsutum*)," PLoS ONE, 2013, vol. 8, No. 6, 13 Pages.

Ek-Ramos, M. J., et al., "Spatial and Temporal Variation in Fungal Endophyte Communities Isolated from Cultivated Cotton (*Gossypium hirsutum*)," Power Point Presentation dated Jan. 7, 2013.

El-Shanshoury, A. R., "Growth Promotion of Wheat Seedlings by Streptomyces atroolivaceus," Journal of Agronomy and Crop Science, 1989, pp. 109-114, vol. 163.

Emerson, D., et al., Identifying and Characterizing Bacteria in an Era of Genomics and Proteomics, BioScience, 2008, pp. 925-936, vol. 58, No. 10.

Endre, G., et al., "A Receptor Kinase Gene Regulating Symbiotic Nodule Development," Nature, 2002, pp. 962-966, vol. 417.

Faria, D. C., et al., "Endophytic Bacteria Isolated from Orchid and Their Potential to Promote Plant Growth," World J Microbiol Biotechnol., 2013, pp. 217-221, vol. 29.

Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.

Fiehn, O., et al., "Metabolite Profiling for Plant Functional Genomics," Nature Biotechnol., 2000, pp. 1157-1161, vol. 8.

Fierer, N., et al., "Cross-Biome Metagenomic Analyses of Soil Microbial Communities and Their Functional Attributes," Proc Natl Acad Sci USA, 2012, pp. 21390-21395, vol. 109, No. 52.

Fincher, G. B., "Molecular and Cellular Biology Associated with Endosperm Mobilization in Germinating Cereal Grains," Annu Rev Plant Physiol Plant Mol Biol., 1989, pp. 305-346, vol. 40.

(56) References Cited

OTHER PUBLICATIONS

Fisher, P. J., et al., "Fungal saprobes and pathogens as endophytes of rice (*Oryza sativa* L.)," New Phytol., 1992, pp. 137-143, vol. 120.
Fisher, P. R., et al., "Isolation and Characterization of the Pesticide-Degrading Plasmid pJP1 from Alcaligenes paradoxus," J Bacteriol., 1978, pp. 798-804, vol. 135, No. 3.
Franco, C., et al., "Actinobacterial Endophytes for Improved Crop Performance," Australasian Plant Pathology, 2007, pp. 524-531, vol. 36.
Fulthorpe, R. R., et al., "Distantly Sampled Soils Carry Few Species in Common," ISME J., 2008, pp. 901-910, vol. 2.
Gantner, S., et al., "Novel Primers for 16S rRNA-based Archaeal Community Analyses in Environmental Samples," J Microbiol Methods, 2011, pp. 12-18, vol. 84.
Gao, Z., et al., "Quantitation of Major Human Cutaneous Bacterial and Fungal Populations," J Clin Microbiol., 2010, pp. 3575-3581, vol. 48, No. 10.
Gasser, I., et al., "Ecology and Characterization of Polyhydroxyalkanoate-Producing Microorganisms on and in Plants," FEMS Microbiol Ecol., 2010, pp. 142-150, vol. 70.
Gavrish, E, et al., "*Lentzea* sp. MS6 16S Ribosomal RNA Gene, Partial Sequence," NCBI GenBank Accession No. EF599958. Submitted May 9, 2007.
Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.
Gitaitis, R., et al., "The Epidemiology and Management of Seedborne Bacterial Diseases," Annu Rev Phytopathol., 2007, pp. 371-397, vol. 45.
Gu, O., et al., "*Glycomyces sambucus* sp. nov., an endophytic actinomycete islolated from the stem of Sambucus adnata Wall," International Journal of Systematic and Evolutionary Microbiology, 2007, pp. 1995-1998, vol. 57.
Haake, V., et al., "Transcription Factor CBF4 is a Regulator of Drought Adaptation in *Arabidopsis*," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Hallman, J., et al., "Bacterial Endophytes in Agricultural Crops," Canadian J Microbiol., 1997, pp. 895-914, vol. 43.
Hardegree, S. P. et al., "Effect of Polyethylene Glycol Exclusion on the Water Potential of Solution-Saturated Filter Paper," Plant Physiol., 1990, pp. 462-466, vol. 92.
Hardoim, P. R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.
Hardoim, P. R., et al., "Dynamics of Seed-Borne Rice Endophytes on Early Plant Growth Stages," PLoS ONE, 2012, vol. 7, No. 2, 13 Pages.
Hepler, P. K., et al., "Polarized Cell Growth in Higher Plants," Annu Rev Cell Dev Biol., 2001, pp. 159-187, vol. 17.
Hiatt, E. E., et al., "Tall Fescue Endophyte Detection: Commerical Immunoblot Test Kit Compared with Microscopic Analysis," Crop Science, 1999, pp. 796-799, vol. 39.
Hibbett, D. S., et al., "A Higher-Level Phylogenetic Classification of the Fungi," Mycol Res., 2007, pp. 509-547, vol. 111.
Hill, N. S., et al., "Endophyte Survival during Seed Storage: Endophyte-Host Interactions and Heritability," Crop Sci., 2009, pp. 1425-1430, vol. 49.
Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.
Hinton, D. M., et al., "Enterobacter cloacae is an endophytic symbiont of corn," Mycopathologia, 1995, pp. 117-125, vol. 129.
Hubbard, M., et al., "Fungal Endophytes Improve Wheat Seed Germination Under Heat and Drought Stress," Botany, 2012, pp. 137-149, vol. 90.

Hung, P.Q., et al., "Isolation and Characterization of Endophytic Bacteria in Soybean (*Glycine* Sp.)," Omonrice, 2004, pp. 92-101, vol. 12.
Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.
Ikeda, S., et al., "The Genotype of the Calcium/Calmodulin-Dependent Protein Kinase Gene (CCaMK) Determines Bacterial Community Diversity in Rice Roots Under Paddy and Upland Field Conditions," Applied and Environmental Microbiology, 2011, pp. 4399-4405, vol. 77, No. 13.
Imoto, K., et al., "Comprehensive Approach to Genes Involved in Cell Wall Modifications in *Arabidopsis thaliana*," Plant Mol Biol., 2005, pp. 177-192, vol. 58.
Jalgaonwala, R., et al., "A Review on Microbial Endophytes from Plants: A Treasure Search for Biologically Active Metabolites," Global Journal of Research on Medicinal Plants & Indigenous Medicine, 2014, pp. 263-277, vol. 3, No. 6.
Janda, J. M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.
Johnston-Monje, D., et al., "Conservation and Diversity of Seed Associated Endophytes in *Zea* Across Boundaries of Evolution, Ethnography and Ecology," PLoS ONE, 2011, vol. 6, No. 6, 22 Pages.
Johnston-Monje, D., et al., "Plant and Endophyte Relationships: Nutrient Management," Comprehensive Biotechnol., 2011, pp. 713-727, vol. 4.
Johnston-Monje, D., "Microbial Ecology of Endophytic Bacteria in *Zea* Species as Influenced by Plant Genotype, Seed Origin, and Soil Environment," Thesis, University of Guelph, 2011, 230 Pages.
Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.
Kaga, H., et al., "Rice Seeds as Sources of Endophytic Bacteria," Microbes Environ., 2009, pp. 154-162, vol. 24, No. 2.
Kalns, L., et al., "The Effects of Cotton Fungal Endophytes in the Field on Arthropod Community Structure," Power Point Presentation dated Jan. 7, 2013.
Kang, B. H., et al., "Members of the *Arabidopsis* Dynamin-Like Gene Family, ADL1, are Essential for Plant Cytokinesis and Polarized Cell Growth," Plant Cell, 2003, pp. 899-913, vol. 15.
Kasana, R. C., et al., "A Rapid and Easy Method for the Detection of Microbial Cellulases on Agar Plates Using Gram's Iodine," Curr Microbiol., 2008, pp. 503-507, vol. 57.
Kruger, M., et al., "DNA-Based Species Level Detection of Glomeromycota: One PCR Primer Set for All Arbuscular Mycorrhizal Fungi," New Phvtol., 2009, pp. 212-223, vol. 183.
Kuklinsky-Sobral, J., et al., "Isolation and Characterization of Endophytic Bacteria from Soybean (*Glycine max*) Grown in Soil Treated with Glyphosate Herbicide," Plant and Soil, 2005, pp. 91-99, vol. 273.
Lanver, D., et al., "Shot and Msb2-Related Proteins Regulate Appressorium Development in the Smut Fungus *Ustilago aydis*," Plant Cell, 2010, pp. 2085-2101, vol. 22.
Laus, M. C., et al., "Role of Cellulose Fibrils and Exopolysaccharides of Rhizobium leguminosarum in Attachment to and Infection of Vicia sativa Root Hairs," Mol Plant Microbe Interact., 2005, pp. 533-538, vol. 18, No. 6.
Leonard, C. A., et al., "Random Mutagenesis of the Aspergillus oryzae Genome Results in Fungal Antibacterial Activity," Int J Microbiol., 2013, vol. 2013, Article ID 901697, 6 Pages.
Li, H. M., et al., "Expression of a Novel Chitinase by the Fungal Endophyte in Poa ampla," Mycologia, 2004, pp. 526-536, vol. 96, No. 3.
Li, Q., "Agrobacterium tumefaciens Strain TA-AT-10 16S Ribosomal RNA Gene, Partial Sequence: GenBank: KF673157.1," Submitted Sep. 17, 2013.
Liu, M., et al., "A Novel Screening Method for Isolating Exopolysaccharide-Deficient Mutants," Appl Environ Microbiol., 1998, pp. 4600-4602, vol. 64, No. 11.

(56) References Cited

OTHER PUBLICATIONS

Liu, Y., et al., "Investigation on Diversity and Population Succession Dynamics of Endophytic Bacteria from Seeds of Maize (*Zea mays* L., Nongda108) at Different Growth Stages," Ann Microbiol., 2013, pp. 71-79, vol. 63.
Liu, D., et al., "Osmotin Overexpression in Potato Delays Development of Disease Symptoms," Proc Natl Acad Sci USA, 1994, pp. 1888-1892, vol. 91.
Liu, Y., et al., "Study on Diversity of Endophytic Bacterial Communities in Seeds of Hybrid Maize and their Parental Lines," Arch Microbiol., 2012, pp. 1001-1012, vol. 194.
Long, H. H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.
Lopez-Lopez, A., et al., "Phaseolus vulgaris Seed-Borne Endophytic Community with Novel Bacterial Species such as *Rhizobium endophyticum* sp. nov.," Systematic Appl Microbiol., 2010, pp. 322-327, vol. 33.
Lorck, H., "Production of Hydrocyanic Acid by Bacteria," Physiol Plant, 1948, pp. 142-146, vol. 1.
Lugtenberg, B., et al., "Plant-Growth-Promoting Rhizobacteria," Ann. Rev. Microbiol., 2009, pp. 541-556, vol. 63.
Lundberg, D. S., et al., "Defining the Core *Arabidopsis thaliana* Root Microbiome," Nature, 2012, pp. 86-90, vol. 488, No. 7409.
Lundberg, D. S., et al., "Practical Innovations for High-Throughput Amplicon Sequencing," Nat Methods, 2013, pp. 999-1002, vol. 10, No. 10.
Ma, Y., et al., "Plant Growth Promoting Rhizobacteria and Endophytes Accelerate Phytoremediation of Metalliferous Soils," Biotechnology Advances, 2011, pp. 248-258, vol. 29.
Madi, L. et al., "Aggregation in Azospirillum brasilense Cd: Conditions and Factors Involved in Cell-to-Cell Adhesion," Plant Soil, 1989, pp. 89-98, vol. 115.
Mannisto, M.K., et al., "Characterization of Psychrotolerant Heterotrophic Bacteria From Finnish Lapland," Svst Appl Microbiol., 2006, pp. 229-243, vol. 29.
Mano, H., et al., "Culturable Surface and Endophytic Bacterial Flora of the Maturing Seeds of Rice Plants (*Oryza sativa*) Cultivated in a Paddy Field," Microbes Environ., 2006, vol. 21, No. 2.
Manter, D. K., et al., "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.
Mao, W., et al., "Seed Treatment with a Fungal or a Bacterial Antagonist for Reducing Corn Damping-off Caused by Species of *Pythium* and *Fusarium*," Plant Disease, 1997, pp. 450-454, vol. 81, No. 5.
Marasco, R., et al., "A Drought Resistance-Promoting Microbiome is Selected by Root System Under Desert Farming," PLoS ONE, 2012, vol. 7, No. 10, 14 Pages.
Marquez, L. M., et al., "A Virus in a Fungus in a Plant: Three-Way Symbiosis Required for Thermal Tolerance," Science, 2007, pp. 513-515, vol. 315.
Mastretta, C., et al., "Endophytic Bacteria from Seeds of Nicotiana Tabacum Can Reduce Cadmium Phytotoxicity," Intl J Phytoremediation, 2009, pp. 251-267, vol. 11.
Mateos, P. F., et al., "Cell-Associated Pectinolytic and Cellulolytic Enzymes in Rhizobium leguminosarum biovar trifolii," Appl Environ Microbiol., 1992, pp. 816-1822, vol. 58, No. 6.
McDonald, D., et al., "An Improved Greengenes Taxonomy with Explicit Ranks for Ecological and Evolutionary Analyses of Bacteria and Archaea," ISME J., 2012, pp. 610-618, vol. 6.
McGuire, K.L., et al., "Digging the New York City Skyline: Soil Fungal Communities in Green Roofs and City Parks," PloS One, 2013, vol. 8, No. 3, 13 Pages.
Medina, P., et al., "Rapid Identification of Gelatin and Casein Hydrolysis Using TCA," J Microbiol Methods, 2007, pp. 391-393, vol. 69.
Mehnaz, S., et al., "Growth Promoting Effects of Corn (*Zea mays*) Bacterial Isolates Under Greenhouse and Field Conditions," Soil Biology and Biochemistry, 2010, pp. 1848-1856, vol. 42.
Michel, B. E., et al., "The Osmotic Potential of Polyethylene Glycol 6000," Plant Physiol., 1973, pp. 914-916, vol. 51.
Moe, L. A., "Amino Acids in the Rhizosphere: From Plants to Microbes," American Journal of Botany, 2013, pp. 1692-1705, vol. 100, No. 9.
Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.
Mousa, W. K., et al., "The Diversity of Anti-Microbial Secondary Metabolites Produced by Fungal Endophytes: An Interdisciplinary Perspective," Front Microbiol., 2013, vol. 4, No. 65, 18 Pages.
Mundt, J.O., et al., "Bacteria Within Ovules and Seeds," Appl Environ Microbiol., 1976, pp. 694-698, vol. 32, No. 5.
Naik, B. S., et al., "Study on the diversity of endophytic communities from rice (*Oryza sativa* L.) and their antagonistic activities in vitro," Microbiological Research, 2009, pp. 290-296, vol. 164.
Naveed, M., "Maize Endophytes—Diversity, Functionality and Application Potential," University of Natural Resources and Life Sciences, 2013, pp. 1-266 and 81-87; Tables 1-3; Figure 2.
Nejad, P. et al., "Endophytic Bacteria Induce Growth Promotion and Wilt Disease Suppression in Oilseed Rape and Tomato," Biological Control, 2000, pp. 208-215, vol. 18.
Neslon, E.B., "Microbial Dynamics and Interactions in the Spermosphere," Ann. Rev. Phytopathol., 2004, pp. 271-309, vol. 42.
Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.
Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.
Okunishi, S., et al., "Bacterial Flora of Endophytes in the Maturing Seeds of Cultivated Rice (*Oryza sativa*)," Microbes and Environment, 2005, pp. 168-177, vol. 20, No. 3.
Orole, O. O., et al., "Bacterial and fungal endophytes associated with grains and roots of maize," Journal of Ecology and the Natural Enviornment, 2011, pp. 298-303, vol. 3, No. 9.
Partida-Martinez, L.P., et al., "The Microbe-Free Plant: Fact or Artifact?" Front Plant Sci., 2011, vol. 2, No. 100, 16 Pages.
Pearson, W.R., et al., "Rapid and Sensitive Sequence Comparison With FASTP and FASTA," Methods Enzymol., 2011, pp. 63-98, vol. 183.
Pedraza, R. O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.
Perez-Fernandez, M. A., et al., "Simulation of Germination of Pioneer Species Along an Experimental Drought Gradient," J Environ Biol., 2006, pp. 669-685, vol. 27, No. 4.
Perez-Miranda, S., et al., "O-CAS, A Fast and Universal Method for Siderophore Detection," J Microbiol Methods, 2007, pp. 127-131, vol. 70.
Petti, C. A., "Detection and Identification of Microorganisms by Gene Amplification and Sequencing," Clinical Infectious Diseases, 2007, pp. 1108-1114, vol. 44.
Phalip, V., et al., "A Method for Screening Diacetyl and Acetoin-Producing Bacteria on Agar Plates," J Basic Microbiol., 1994, pp. 277-280, vol. 34.
Philippot, L., et al., "Going Back to the Roots: The Microbial Ecology of the Rhizosphere," Nat Rev Microbiol., Nov. 2013, pp. 789-799, vol. 11.
Pillay, V. K., et al., "Inoculum Density, Temperature, and Genotype Effects on in vitro Growth Promotion and Epiphytic and Endophytic Colonization of Tomato (*Lycopersicon esculentum* L.) Seedlings Inoculated with a Pseudomonad Bacterium," Can J Microbiol., 1997, pp. 354-361, vol. 43.
Powell, W. A., et al., "Evidence of Endophytic Beauveria Bassiana in Seed-Treated Tomato Plants Acting as a Systemic Entomopathogen

(56) References Cited

OTHER PUBLICATIONS to Larval Helicoverpa zea (Lepidoptera: Noctuidae)," J. Entomol. Sci., 2009, pp. 391-396, vol. 44, No. 4.

Quadt-Hallmann, A., et al., "Bacterial Endophytes in Cotton: Mechanisms of Entering the Plant," Can J Microbiol., 1997, pp. 577-582, vol. 43.

R Core Team, "R: A Language and Environment for Statistical Computing," R Foundation for Statistical Computing, Vienna, Austria, May 2013, ISBN: 3-900051-07-0. Available online at http://www.R- 25project.org/, 3604 Pages.

Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.

Redman, R. S., et al., "Thermotolerance Generated by Plant/Fungal Symbiosis," Science, Nov. 2002, vol. 298, 1 Page (with 4 pages of supplemental material).

Reiter, B., et al., "Response of Endophytic Bacterial Communities in Potato Plants to Infection with *Erwinia carotovora* subsp. *atroseptica*," Appl Environ Microbiol., 2001, pp. 2261-2268, vol. 68, No. 5.

Rodriguez, H., et al., "Expression of a Mineral Phosphate Solubilizing Gene From Erwinia herbicola in Two Rhizobacterial Strains," J Biotechnol., 2001, pp. 155-161, vol. 84.

Rodriguez, R.J., et al., "Stress Tolerance in Plants via Habitat-Adapted Symbiosis," ISME J., 2008, pp. 404-416, vol. 2.

Rodriguez-Navarro, D., et al., "Soybean Interactions with Soil Microbes, Agronomical and Molecular Aspects," Agronomy for Sustainable Development, 2011, pp. 173-190, vol. 31, No. 1.

Roessner, U., et al., "Metabolic Profiling Allows Comprehensive Phenotyping of Genetically or Environmentally Modified Plant Systems," Plant Cell, 2001,pp. 11-29, vol. 13.

Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.

Rosenblueth, A., et al., "Seed Bacterial Endophytes: Common Genera, Seed-to-Seed Variability and Their Possible Role in Plants," Acta Hort., 2012, pp. 39-48, vol. 938.

Rosenblueth, M., et al., "Bacterial Endophytes and Their Interactions With Host," Molecular Plant-Microbe Interactions, 2006, pp. 827-837, vol. 19, No. 8.

Ross, P.L., et al., "Multiplexed Protein Quantitation in *Saccharomyces cerevisiae* Using Amine-Reactive Isobaric Tagging Reagents," Mol Cell Proteomics, 2004, pp. 1154-1169, vol. 3, No. 12.

Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.

Samac, D.A., et al., "Recent Advances in Legume-Microbe Interactions: Recognition, Defense Response, and Symbiosis from a Genomic Perspective," Plant Physiol., 2007, pp. 582-587, vol. 144.

Sardi, P., et al., "Isolation of Endophytic Streptomyces Strains from Surface Sterilized Roots," Applied and Environmental Microbiology, 1992, pp. 2691-2693, vol. 58, No. 8.

Sarwar, M., et al., "Tryptophan Dependent Biosynthesis of Auxins in Soil," Plant Soil, 1992, pp. 207-215, vol. 147.

Schmieder, R., et al., "Quality Control and Preprocessing of Metagenomic Datasets," Bioinformatics, 2011, pp. 863-864, vol. 27, No. 6.

Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.

Schwyn, B. et al., "Universal Chemical Assay for the Detection and Determination of Siderophores," Analytical Biochemistry, 1987, pp. 47-56, vol. 160.

Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.

Singh, A. K., et al., "Uncultured *Actinomyces* sp. Clone EMLACT 80 IV (New) 16S Ribosomal RNA Gene, Partial Sequence," NCBI GenBank Accession No. JQ285908. Submitted Dec. 13, 2011.

Soares, M. M. C. N., et al., "Screening of Bacterial Strains for Pectinolytic Activity: Characterization of the Polygalacturonase Produced by *Bacillus* Sp," Revista de Microbiolgia, 1999, pp. 299-303, vol. 30.

Song, M., et al., "Effects of Neotyphodium Endophyte on Germination of Hordeum brevisubulatum under Temperature and Water Stress Conditions," Acta Agrestia Sinica, 2010, pp. 834-837, vol. 18, No. 6. (English Abstract).

Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.

Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.

Staudt, A. K., et al., "Variations in Exopolysaccharide Production by Rhizobium tropici," Arch Microbiol., 2012, pp. 197-206, vol. 194.

Strobel, G. A., "Endophytes as Sources of Bioactive Products," Microbes and Infection, 2003, pp. 535-544, vol. 5.

Sturz, A. V., et al., "Weeds as a Source of Plant Growth Promoting Rhizobacteria in Agricultural Soils," Can J Microbiol., 2001, pp. 1013-1024, vol. 47, No. 11.

Surette, M. A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.

Suto, M., et al., "Endophytes as Producers of Xylanase," J Biosci Bioeng., 2002, pp. 88-90, vol. 93, No. 1.

Sword, G., "Manipulating Fungal Endophytes to Protect Plants from Insects and Nematodes," Power Point Presentation dated Aug. 7, 2013.

Sword, G., et al., "Manipulating Fungal Endophytes for the Protection of Cotton in the Field," Power Point Presentation dated Jan. 7, 2013.

Sword, G., et al., "Field Trials of Potentially Beneficial Fungal Endophytes in Cotton," Power Point Presentation dated Jan. 7, 2013.

Sword, G., "Fungal Endophytes to Protect Cotton from Insects and Nematodes," Power Point Presentation dated Dec. 7, 2012.

Sword, G., "Natural Enemies—The Forgotten Basis of IPM?," Power Point Presentation dated Sep. 6, 2013.

Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.

Taylor, A. G., et al., "Concepts and Technologies of Selected Seed Treatments," Annu. Rev. Phytopathol., 1990, pp. 321-339, vol. 28.

Teather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.

Theis, K. R., et al., "Uncultured Bacterium Clone GM2GI8201A64RC 16S Ribosomal RNA Gene, Partial Sequence," NCBI GenBank Accession No. JX051943, Submitted May 14, 2012.

Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.

Thomashow, M. F., "So What's New in the Field of Plant Cold Acclimation? Lots!," Plant Physiol., 2001, pp. 89-93, vol. 125.

Tokala, R. T., et al., "Novel Plant-Microbe Rhizosphere Interaction Involving Streptomyces Lydicus WYEC108 and the Pea Plant (*Pisum sativum*)," Applied and Environmental Microbiology, May 2002, pp. 2161-2171, vol. 68, No. 5.

Trotel-Aziz, P., et al., "Characterization of New Bacterial Biocontrol Agents *Acinetobacter, Bacillus, Pantoea* and *Pseudomonas* spp.

(56) References Cited

OTHER PUBLICATIONS

Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed *Arabidopsis thaliana*," Plant Biol., 2013, pp. 971-981, vol. 15.
Usadel, B., et al., "The Plant Transcriptome—From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C. U., et al., "Endophytic Establishment as an Unintended Consequence of Biocontrol with Fungal Entomopathogens," Power Point Presentation dated Jan. 7, 2013.
Van Der Lelie, D., et al., "Poplar and its Bacterial Endophytes: Coexistence and Harmony," Critical Rev Plant Sci., 2009, pp. 346-358, vol. 28.
Vining, K., et al., "Methylome Reorganization During in vitro Dedifferentiation and Regeneration of Populus trichocarpa," BMC Plant Biol., 2013, vol. 13, No. 92, 15 Pages.
Viruel, E., et al., "Pseudomonas thiveralensis Strain IEHa 16S Ribosomal RNA Fene, Partial Sequence," NCBI GenBank Accession No. GQ169380.1, Submitted May 15, 2009.
Waller, F., et al., "The Endophytic Fungus *Piriformospora indica* Reprograms Barley to Salt-Stress Tolerance, Disease Resistance, and Higher Yield," PNAS, 2005, pp. 13386-13391, vol. 102, No. 38.
Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.
Wang, Q., et al., "Naive Bayesian Classifier for Rapid Assignment of rRNA Sequences into the New Bacterial Taxonomy," Appl. Environ. Microbiol., 2007, pp. 5261-5267, vol. 73, No. 16.
Weaver, P.F., et al., "Characterization of Rhodopseudomonas capsulata," Arch Microbiol., 1975, pp. 207-216, vol. 105.
Welty, R.E., et al., "Influence of Moisture Content, Temperature, and Length of Storage on Seed Germination and Survival of Endophytic Fungi in Seeds of Tall Fescue and Perennial Ryegrass," Phytopathol., 1987, pp. 893-900, vol. 77, No. 6.
White, J. F., et al., "A Proposed Mechanism for Nitrogen Acquisition by Grass Seedlings Through Oxidation of Symbiotic Bacteria," Symbiosis, 2012, pp. 161-171, vol. 57.
Wiegand, I., et al., "Agar and Broth Dilution Methods to Determine the Minimal Inhibitory Concentration (MIC) of Antimicrobial Substances," Nature Protocols, 2008, pp. 163-175, vol. 3, No. 2.
Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings," World J Microbiol Biotechnol., 2014, pp. 835-845, vol. 30.
Xu, Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.
Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.
Yezerski, A., et al., "The Effects of the Presence of Stored Product Pests on the Microfauna of a Flour Community," Journal of Applied Microbiology, 2005, pp. 507-515, vol. 98.
You, Y., et al., "Analysis of Genomic Diversity of Endophytic Fungal Strains Isolated from the Roots of *Suaeda japonica* and *S. maritima* for the Restoration of Ecosystems in Buan Salt Marsh," Korean Journal of Microbiology and Biotechnology, 2012, pp. 287-295, vol. 40, No. 4. (with English Abstract).
Zhou, W., et al., "Effects of the Fungal Endophyte *Paecilomyces* sp. in Cotton on the Roo-Knot Nematode *Meloidogyne incognita*," poster dated Jan. 7, 2013.
Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.
Zuccaro, A., et al., "Endophytic Life Strategies Decoded by Genome and Transcriptome Analyses of the Mutualistic Root Symbiont *Piriformospora indica*," PLOS Pathogens, 2011, vol. 7, No. 10, e1002290.
Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.
Intellectual Property Australia, Examination Report for Australian Patent Application No. 2016202480, dated Apr. 28, 2016, 2 Pages.
New Zealand Intellectual Property Office, First Examination Report, New Zealand Patent Application No. 715728, dated May 10, 2016, 4 Pages.
Abello, J., et al., "Agrobacterium-mediated transformation of the endophytic fungus Acremonium implicatum associated with Brachiaria grasses", Mycological Research, pp. 407-413, vol. 112, Pt 3.
Bandara, W.M.M.S., et al., "Interactions among endophytic bacteria and fungi: effects and potentials", Journal of Biosciences, Dec. 2006, vol. 31, No. 5, pp. 645-650.
Partida-Martinez, L.P., et al., "Endosymbiont-Dependent Host Reproduction Maintains Bacterial-Fungal Mutualism", Current Biology, May 1, 2007, vol. 17, No. 9, pp. 773-777.

\* cited by examiner

FIG 1A
SYM15779 (native complex endophyte)
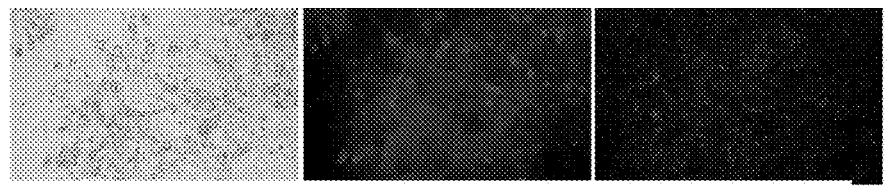
SYM15779 (-) (cured of component and surface bacteria)
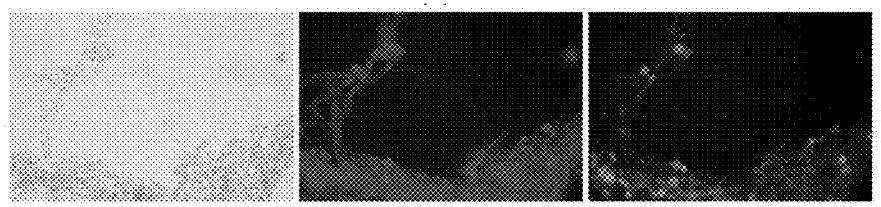

FIG 1B
SYM15890 (fungus with surface bacteria)
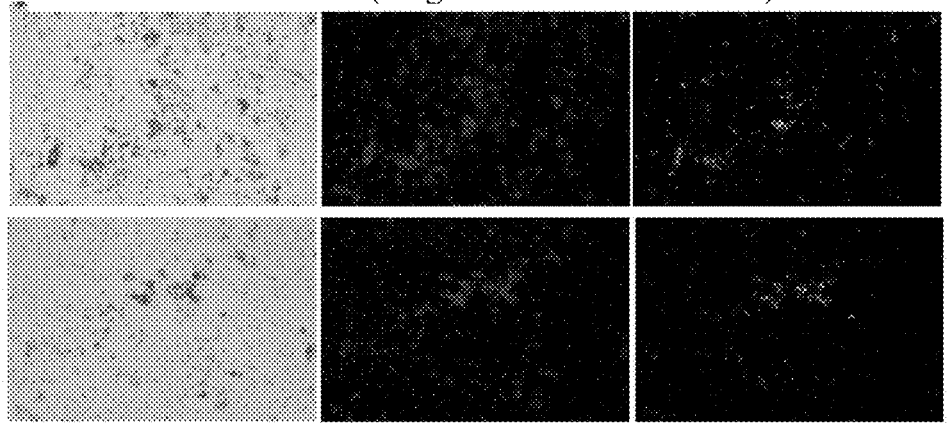
SYM15890 (-) (cured of surface bacteria)
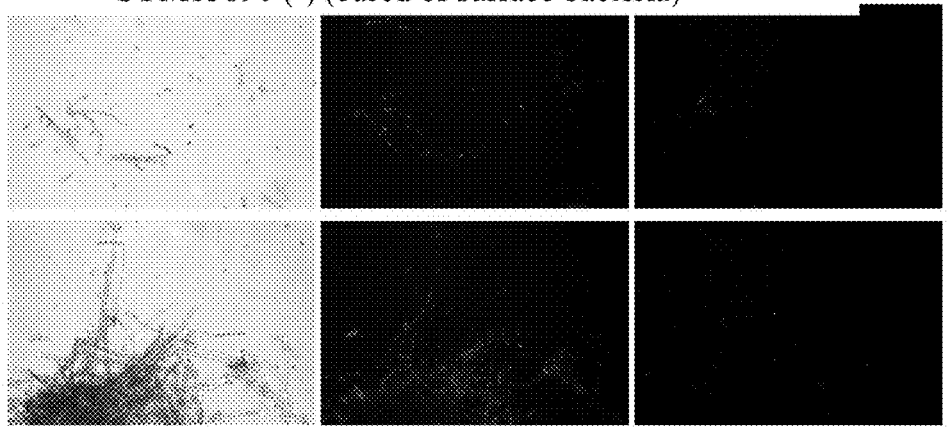

| Isolated complex endophyte | Cured Fungal Host | Isolated Bacterial Component |
|---|---|---|
| SYM15779 FIG. 2A | 15779 genus *Mucor* FIG. 2B | EHB15779 genus *Pantoea* FIG. 2C |
| SYM166 FIG. 2D | 166 genus *Pestalotiopsis* FIG. 2E | EHB166 genus *Luteibacter* FIG. 2F |

| Native Fungal (non-complex) Endophyte | Verification (after "curing" step) | Bacterial Endophyte | |
|---|---|---|---|
| SYM15890  FIG.3A | 15890 genus *Cladosporium* 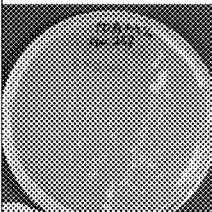 FIG.3B | | |
| | | SYM292 genus *Paenibacillus* 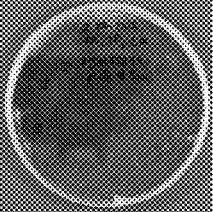 FIG.3C | |
| | | SYM257 Genus *Streptomyces* 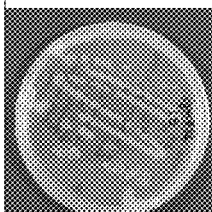 FIG.3D | |

FIG. 9A: Cured fungal host SYM15779
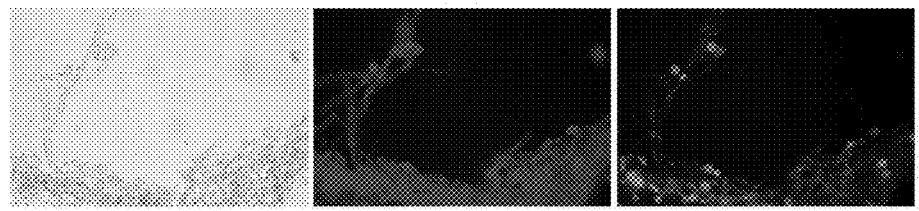
FIG 9B: Designed Complex Endophyte 15779+292
FIG. 9C: Designed Complex Endophyte 15776+EHB166
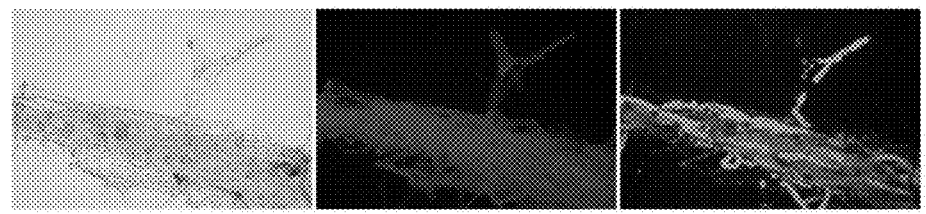

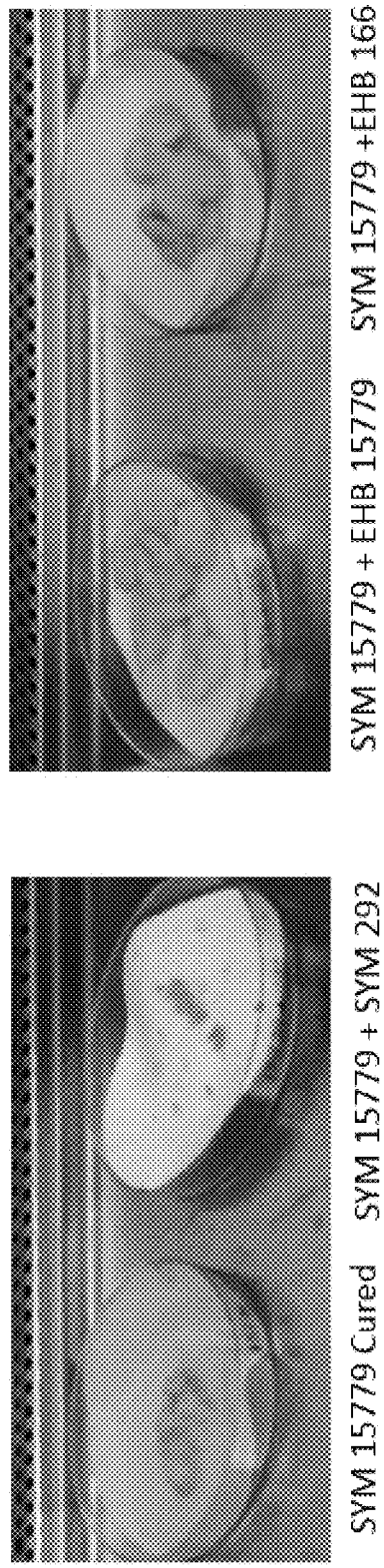
FIG. 10: Dried biomass for seed treatments

DESIGNED COMPLEX ENDOPHYTE COMPOSITIONS AND METHODS FOR IMPROVED PLANT TRAITS

CROSS REFERENCE TO RELATED APPLICATIONS

This application claims the benefit of U.S. Provisional Application No. 62/156,006, filed May 1, 2015, which is hereby incorporated in its entirety by reference.

SEQUENCE LISTING

The instant application contains a Sequence Listing with 758 sequences which has been submitted via EFS-Web and is hereby incorporated by reference in its entirety. Said ASCII copy, created on Apr. 29, 2016, is named 33789_US_sequencelisting.txt, and is 729,088 bytes in size.

FIELD OF THE INVENTION

This invention relates to compositions and methods for improving the cultivation of plants, particularly agricultural plants such as maize, wheat, barley, sorghum, millet, rice, soybean, canola, rapeseed, cotton, alfalfa, sugarcane, cassava, potato, tomato, and vegetables. For example, this invention describes fungal endophytes that comprise additional components, such as bacteria, that may be used to impart improved agronomic traits to plants. The disclosed invention also describes methods of improving plant characteristics by introducing fungal endophytes that comprise additional components to those plants. Further, this invention also provides methods of treating seeds and other plant parts with fungal endophytes that further comprise additional components, to impart improved agronomic characteristics to plants, particularly agricultural plants. Further, this invention provides novel compositions and methods of endofungal endophytes that are synthesized from individual fungal and bacterial components, to provide benefits to agriculture and other fields.

BACKGROUND OF THE INVENTION

According the United Nations Food and Agricultural Organization (UN FAO), the world's population will exceed 9.6 billion people by the year 2050, which will require significant improvements in agriculture to meet growing food demands. At the same time, conservation of resources (such as water, land), reduction of inputs (such as fertilizer, pesticides, herbicides), environmental sustainability, and climate change are increasingly important factors in how food is grown. There is a need for improved agricultural plants and farming practices that will enable the need for a nearly doubled food production with fewer resources, more environmentally sustainable inputs, and with plants with improved responses to various biotic and abiotic stresses (such as pests, drought, disease).

Today, crop performance is optimized primarily via technologies directed towards the interplay between crop genotype (e.g., plant breeding, genetically-modified (GM) crops) and its surrounding environment (e.g., fertilizer, synthetic herbicides, pesticides). While these paradigms have assisted in doubling global food production in the past fifty years, yield growth rates have stalled in many major crops and shifts in the climate have been linked to production instability and declines in important crops, driving an urgent need for novel solutions to crop yield improvement. In addition to their long development and regulatory timelines, public fears of GM-crops and synthetic chemicals have challenged their use in many key crops and countries, resulting in a lack of acceptance for many GM traits and the exclusion of GM crops and many synthetic chemistries from some global markets. Thus, there is a significant need for innovative, effective, environmentally-sustainable, and publically-acceptable approaches to improving the yield and resilience of crops to stresses.

Improvement of crop resilience to biotic and abiotic stresses has proven challenging for conventional genetic and chemical paradigms for crop improvement. This challenge is in part due to the complex, network-level changes that arise during exposure to these stresses. For example, plants under stress can succumb to a variety of physiological and developmental damages, including dehydration, elevated reactive oxygen species, impairment of photosynthetic carbon assimilation, inhibition of translocation of assimilates, increased respiration, reduced organ size due to a decrease in the duration of developmental phases, disruption of seed development, and a reduction in fertility.

Like humans, who utilize a complement of beneficial microbial symbionts, plants have been purported to derive a benefit from the vast array of bacteria and fungi that live both within and around their tissues in order to support the plant's health and growth. Endophytes are symbiotic organisms (typically bacteria or fungi) that live within plants, and inhabit various plant tissues, often colonizing the intercellular spaces of host leaves, stems, flowers, fruits, seeds, or roots. To date, a small number of symbiotic endophyte-host relationships have been analyzed in limited studies to provide fitness benefits to model host plants within controlled laboratory settings, such as enhancement of biomass production and nutrition, increased tolerance to stress such as drought and pests. There is still a need to develop better plant-endophyte systems to confer benefits to a variety of agriculturally-important plants such as maize and soybean, for example to provide improved yield and tolerance to the environmental stresses present in many agricultural situations for such agricultural plants.

There are very few examples of "designed complex endophytes", or endophytes further comprising another component (such as a virus, or a bacterium), that have been described in the literature, including: a survey of cupressaceous trees (Hoffman and Arnold, 2010 Appl. Environ. Microbiol. 76: 4063-4075, incorporated herein by reference in its entirety) and one species of tropical grasses (Marquez et al., 2007 Science 315: 513-515). Desirò et al. (2014 ISME J. 8: 257-270, incorporated herein by reference in its entirety) describe the existence of more than one species of bacteria residing within a fungal endophyte. It has been demonstrated that at least one of these endofungal bacteria is able to produce a plant hormone that enhances plant growth and others can produce substances with anti-cancer and anti-malaria properties (Hoffman et al., 2013 PLOS One 8: e73132; Jung and Arnold, 2012 The Effects of Endohyphal Bacteria on Anti-Cancer and Anti-Malaria Metabolites of Endophytic Fungi, Honors Thesis, University of Arizona, incorporated herein by reference in their entirety). However, these designed complex endophytes have not been shown to exist in cultivated plants of agricultural importance such as maize, soybean, wheat, cotton, rice, etc. As such, bacteria isolated from such designed complex endophytes, or bacteria capable of existing within a host fungus, or a host fungus capable of comprising a component bacterium, have not previously been conceived as a viable mechanism to address the need to provide improved yield and tolerance to environmental stresses for plants of agricultural importance.

Thus, there is a need for compositions and methods of providing agricultural plants with improved yield and tolerance to various biotic and abiotic stresses. Provided herein are novel compositions of designed complex endophytes, formulations of designed complex endophytes for treatment of plants and plant parts, novel designed complex endophyte-plant compositions, and methods of use for the same, created based on the analysis of the key properties that enhance the utility and commercialization of a designed complex endophyte composition.

SUMMARY OF THE INVENTION

Disclosed herein is a method of creating a designed complex endophyte comprising at least one bacterium within a heterologous fungus, comprising: a) isolating and purifying a bacterium; b) isolating and purifying a fungus; c) co-culturing the bacterium with the fungus in a liquid medium; and d) incubating the co-cultured bacterium and fungus at a temperature not exceeding 35 degrees Celsius.

In some embodiments, step a) is conducted at a temperature range selected from the group consisting of: between 18° C. and 36° C., between 20° C. and 30° C., between 20° C. and 26° C., between 20.0° C. and 25.5° C., between 22.0° C. and 25.0° C., and between 23.0° C. and 24.0° C. In some embodiments, the method further comprises after step b): treating the fungus with one or more antibiotics to cure the fungus of any component bacteria. In some embodiments, the method further comprises plating the co-cultures on 2% water agar for a minimum of 1 week, then transferring the co-culture to full-strength PDA/LB agar.

In some embodiments, the co-cultured bacterium and fungus are incubated at a temperature range selected from the group consisting of: between 18° C. and 36° C., between 20° C. and 30° C., between 20° C. and 26° C., between 20.0° C. and 25.5° C., between 22.0° C. and 25.0° C., and between 23.0° C. and 24.0° C.; and/or the incubated co-cultured bacterium and fungus are further treated with gentamicin; and/or the co-cultured bacterium and fungus are further plated onto broth and/or agar, with gentamicin, e.g., the cultures are washed with magnesium chloride no fewer than three times, and/or the concentration of gentamicin is selected from the group consisting of: 5 micrograms per mL, 20 micrograms per mL, 50 micrograms per mL, and 75 micrograms per mL.

Also disclosed herein is a synthetic composition comprising a fungal endophyte encapsulating a heterologous bacterial endophyte. In some embodiments, synthetic composition comprises a plant element, and, optionally, the synthetic composition is capable of providing a trait of agronomic importance to the plant element or plant with which the plant element is associated. Also disclosed herein is a synthetic composition, comprising a plant element associated with a designed complex endophyte, wherein the designed complex endophyte is capable of providing a trait of agronomic importance to the plant element or plant with which the plant element is associated.

In some embodiments, the trait of agronomic importance is selected from the group consisting of: altered oil content, altered protein content, altered seed carbohydrate composition, altered seed oil composition, altered seed protein composition, increased chemical tolerance, increased cold tolerance, delayed senescence, increased disease resistance, increased drought tolerance, increased ear weight, growth improvement, health enhancement, increased heat tolerance, increased herbicide tolerance, increased herbivore resistance, improved nitrogen fixation, improved nitrogen utilization, improved nutrient use efficiency, improved root architecture, improved water use efficiency, increased biomass, increased root length, increased seedling root length, germination rate, increased seed weight, increased shoot length, increased seedling shoot length, increased shoot biomass, seedling mass, seedling root surface area, increased yield, increased yield under water-limited conditions, increased kernel mass, improved kernel moisture content, increased metal tolerance, increased number of ears, increased number of kernels per ear, increased number of pods, nutrition enhancement, improved pathogen resistance, improved pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased seed germination, increased number of pods per plant, increased length of pods per plant, reduced number of wilted leaves per plant, reduced number of severely wilted leaves per plant, increased number of non-wilted leaves per plant, increased plant height, earlier or increased flowering, increased protein content, increased fermentable carbohydrate content, reduced lignin content, male sterility, and increased antioxidant content. In some embodiments, the trait of agronomic importance is selected from the group consisting of: germination rate, emergence rate, shoot biomass, root biomass, seedling root length, seedling shoot length, and yield. In some embodiments, the trait of agronomic importance is improved under normal watering conditions or the trait of agronomic importance is improved under conditions of water limitation. In some embodiments, wherein the fungal endophyte is capable of modulating at least one of: a trait of agronomic importance, the transcription of a gene, the expression of a protein, the level of a hormone, the level of a metabolite, and the population of endogenous microbes in plants associated with, or grown from the plant element, as compared to isoline plants not associated with, or grown from plant elements associated with, the fungal endophyte.

In some embodiments, the synthetic compositions described herein further comprises an agronomic formulation that further comprises one or more of the following: a stabilizer, or a preservative, or a carrier, or a surfactant, or an anticomplex agent, fungicide, nematicide, bactericide, insecticide, and herbicide, or any combination thereof. In some embodiments, wherein the designed complex endophyte is present in an amount of at least about 10^2 CFU per plant element.

In some embodiments, the synthetic compositions described herein comprise a designed complex endophyte comprising a host fungus from a class selected from the group consisting of: Dothideomycetes, Sordariomycetes, Mucoromycotina, Pezizomycotina, or any of the corresponding anamorph or teleomorph taxonomy of the preceding; and/or a bacterium from a class selected from the group consisting of: Bacilli, Gammaproteobacteria, Actinobacteria; and/or a host fungus from an order selected from the group consisting of: Sordariomycetes, Xylariales, Mucorales, Capnodiales, or any of the corresponding anamorph or teleomorph taxonomy of the preceding; and/or a bacterium from an order selected from the group consisting of: Bacillales, Enterobacteriales, Xanthomonadales, Actinomycetales; and/or a host fungus from a family selected from the group consisting of: Mycospharellaceae, Davidiellacea, Mucoraceae, Xylariomycetidae, Amphisphaeriacea, or any of the corresponding anamorph or teleomorph taxonomy of the preceding; and/or a bacterium from a family selected from the group consisting of: Paenibacillaceae, Enterobacteriaceae, Xanthomonadaceae, Streptomycetaceae; and/or a host fungus from a genus selected from the group consisting of: *Pestalotiopsis, Mucor, Cladosporium*, or any of the corresponding anamorph or teleomorph taxonomy of the preceding; and/or a bacterium from a genus selected from the group consisting of: *Pantoea, Paenibacillus, Luteibacter, Streptomyces*. In some embodiments, the synthetic compositions described herein comprise a designed complex endophyte selected from the compositions listed in Table 3.

In some embodiments, the synthetic compositions described herein comprise a fungus comprising a nucleic acid sequence at least 95% identical to a nucleic acid sequence selected from the group consisting of SEQ ID NO: 561 through SEQ ID NO: 758; and/or a bacterium comprising a nucleic acid sequence at least 95% identical to a nucleic acid sequence selected from the group consisting of SEQ ID NO: 1 through SEQ ID NO: 560.

In some embodiments, the synthetic compositions described herein comprise a fungal endophyte is associated with a plant element but is not directly contacting the plant element. In some embodiments, the synthetic compositions described herein comprise designed complex endophyte capable of modulating at least one of: a trait of agronomic importance, the transcription of a gene, the expression of a protein, the level of a hormone, the level of a metabolite, and the population of endogenous microbes in plants grown from the seeds, as compared to isoline plants not associated with, or grown from plant elements associated with, the designed complex endophyte.

In some embodiments, the synthetic compositions described herein comprise designed complex endophyte present in an amount of at least about $10^2$ CFU per plant element. In some embodiments, the synthetic compositions described herein comprise a designed complex endophyte comprises a host fungus from a class selected from the group consisting of: Dothideomycetes, Sordariomycetes, Mucoromycotina, Pezizomycotina, or any of the corresponding anamorph or teleomorph taxonomy of the preceding; and/or a bacterium from a class selected from the group consisting of: Bacilli, Gammaproteobacteria, Actinobacteria; and/or a host fungus from an order selected from the group consisting of: Sordariomycetes, Xylariales, Mucorales, Capnodiales, or any of the corresponding anamorph or teleomorph taxonomy of the preceding; and/or a bacterium from an order selected from the group consisting of: Bacillales, Enterobacteriales, Xanthomonadales, Actinomycetales; and/or a host fungus from a family selected from the group consisting of: Mycospharellaceae, Davidiellacea, Mucoraceae, Xylariomycetidae, Amphisphaeriacea, or any of the corresponding anamorph or teleomorph taxonomy of the preceding; and/or a bacterium from a family selected from the group consisting of: Paenibacillaceae, Enterobacteriaceae, Xanthomonadaceae, Streptomycetaceae; and/or a host fungus from a genus selected from the group consisting of: *Pestalotiopsis, Mucor, Cladosporium*, or any of the corresponding anamorph or teleomorph taxonomy of the preceding; and/or a bacterium from a genus selected from the group consisting of: *Pantoea, Paenibacillus, Luteibacter, Streptomyces*.

In some embodiments, the synthetic compositions described herein comprise a designed complex endophyte comprising a nucleic acid sequence at least 95% identical to a nucleic acid sequence selected from the group consisting of SEQ ID NO: 1 through SEQ ID NO: 758; and/or a designed complex endophyte selected from those listed in Table 3. In some embodiments, the synthetic compositions described herein comprise a designed complex endophyte associated with a plant element but is not directly contacting the plant element.

In some embodiments, the synthetic compositions described herein comprise a plant element selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud; and/or from a plant selected from the group consisting of: wheat, soybean, maize, cotton, canola, barley, sorghum, millet, rice, rapeseed, alfalfa, tomato, sugarbeet, sorghum, almond, walnut, apple, peanut, strawberry, lettuce, orange, potato, banana, sugarcane, potato, cassava, mango, guava, palm, onions, olives, peppers, tea, yams, cacao, sunflower, asparagus, carrot, coconut, lemon, lime, barley, watermelon, cabbage, cucumber, grape, and turfgrass.

Also described herein is a plurality of synthetic compositions described herein, confined within an object selected from the group consisting of: bottle, jar, ampule, package, vessel, bag, box, bin, envelope, carton, container, silo, shipping container, truck bed, and case; and/or placed in a medium that promotes plant growth, the medium selected from the group consisting of: soil, hydroponic apparatus, and artificial growth medium, e.g., the medium is soil, wherein the synthetic compositions are placed in the soil with substantially equal spacing between each seed. In some embodiments, the synthetic compositions are shelf-stable.

Also described herein is a plant grown from the synthetic combination described herein wherein the plant exhibits an improved phenotype of agronomic interest, selected from the group consisting of: altered oil content, altered protein content, altered seed carbohydrate composition, altered seed oil composition, altered seed protein composition, increased chemical tolerance, increased cold tolerance, delayed senescence, increased disease resistance, increased drought tolerance, increased ear weight, growth improvement, health enhancement, increased heat tolerance, increased herbicide tolerance, increased herbivore resistance, improved nitrogen fixation, improved nitrogen utilization, improved nutrient use efficiency, improved root architecture, improved water use efficiency, increased biomass, increased root length, increased seedling root length, germination rate, increased seed weight, increased shoot length, increased seedling shoot length, increased shoot biomass, seedling mass, seedling root surface area, increased yield, increased yield under water-limited conditions, increased kernel mass, improved kernel moisture content, increased metal tolerance, increased number of ears, increased number of kernels per ear, increased number of pods, nutrition enhancement, improved pathogen resistance, improved pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased seed germination, increased number of pods per plant, increased length of pods per plant, reduced number of wilted leaves per plant, reduced number of severely wilted leaves per plant, increased number of non-wilted leaves per plant, increased plant height, earlier or increased flowering, increased protein content, increased fermentable carbohydrate content, reduced lignin content, male sterility, and increased antioxidant content. In some embodiments, the plant or progeny of the plant comprises in at least one of its plant elements the fungal endophyte, the bacterial endophyte, designed complex endophyte, fungal host, or bacterial component.

Also described herein is a method of inoculating a plant with a designed complex endophyte, comprising contacting a plant element of the plant with a formulation comprising the designed complex endophyte; a method of inoculating a plant with a fungal endophyte, comprising contacting a plant element of the plant with a formulation comprising a designed complex endophyte, wherein the designed complex endophyte comprises the fungal endophyte; and a method of inoculating a plant with a bacterial endophyte, comprising contacting a plant element of the plant with a formulation comprising a designed complex endophyte, wherein the designed complex endophyte comprises the bacterial endophyte. In some embodiments, the methods of inoculation improve a trait of agronomic importance in the plant.

Also described herein is a method of improving a trait of agronomic importance in a plant, comprising contacting a plant element with a formulation comprising a designed complex endophyte; as compared to an isoline plant associated with the designed complex endophyte and a method of improving a trait of agronomic importance in a plant, comprising growing the plant from a plant reproductive element that has been contacted with a formulation comprising a designed complex endophyte; as compared to an isoline plant grown from a plant reproductive element not associated with the designed complex endophyte; a method of improving a trait of agronomic importance in a plant, comprising contacting a plant element with a formulation comprising a designed complex endophyte, wherein the designed complex endophyte comprises a bacterium within a heterologous host fungus; as compared to an isoline plant not associated with the bacterium; a method of improving a trait of agronomic importance in a plant, comprising contacting a plant element with a formulation comprising a designed complex endophyte, wherein the designed complex endophyte comprises a first fungus within a heterologous host fungus; as compared to an isoline plant not associated with the first fungus; a method of improving a trait of agronomic importance in a plant, comprising contacting a plant element with a formulation comprising a designed complex endophyte, wherein the designed complex endophyte comprises a bacterium within a heterologous fungus; as compared to an isoline plant not associated with the fungus; a method of improving a trait of agronomic importance in a plant, comprising growing the plant from a plant reproductive element that has been contacted with a formulation comprising a designed complex endophyte, wherein the designed complex endophyte comprises a bacterium within a heterologous fungus; as compared to an isoline plant grown from a plant reproductive element not associated with the bacterium; a method of improving a trait of agronomic importance in a plant, comprising growing the plant from a plant reproductive element that has been contacted with a formulation comprising a designed complex endophyte, wherein the designed complex endophyte comprises a first fungus within a heterologous host fungus; as compared to an isoline plant grown from a plant reproductive element not associated with the first fungus; and a method of improving a trait of agronomic importance in a plant, comprising growing the plant from a plant reproductive element that has been contacted with a formulation comprising a designed complex endophyte, wherein the designed complex endophyte comprises a bacterium within a heterologous fungus; as compared to an isoline plant grown from a plant reproductive element not associated with the fungus.

In some embodiments of the methods described herein, the designed complex endophyte comprises a bacterium within a heterologous host fungus; and/or the designed complex endophyte comprises a fungus within a heterologous host fungus.

In some embodiments of the methods described herein, the trait of agronomic importance is selected from the group consisting of: altered oil content, altered protein content, altered seed carbohydrate composition, altered seed oil composition, altered seed protein composition, increased chemical tolerance, increased cold tolerance, delayed senescence, increased disease resistance, increased drought tolerance, increased ear weight, growth improvement, health enhancement, increased heat tolerance, increased herbicide tolerance, increased herbivore resistance, improved nitrogen fixation, improved nitrogen utilization, improved nutrient use efficiency, improved root architecture, improved water use efficiency, increased biomass, increased root length, increased seedling root length, germination rate, increased seed weight, increased shoot length, increased seedling shoot length, increased shoot biomass, seedling mass, seedling root surface area, seedling mass, seedling root surface area, increased yield, increased yield under water-limited conditions, increased kernel mass, improved kernel moisture content, increased metal tolerance, increased number of ears, increased number of kernels per ear, increased number of pods, nutrition enhancement, improved pathogen resistance, improved pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased seed germination, increased number of pods per plant, increased length of pods per plant, reduced number of wilted leaves per plant, reduced number of severely wilted leaves per plant, increased number of non-wilted leaves per plant, increased plant height, earlier or increased flowering, increased protein content, increased fermentable carbohydrate content, reduced lignin content, male sterility, and increased antioxidant content. In some embodiments of the methods described herein, the trait of agronomic importance is selected from the group consisting of: germination rate, emergence rate, shoot biomass, seedling root length, seedling shoot length, seedling mass, seedling root surface area, and yield. In some embodiments of the methods described herein, the trait of agronomic importance is improved under normal watering conditions. In some embodiments of the methods described herein, the trait of agronomic importance is improved under conditions of water limitation.

In some embodiments of the methods described herein, the designed complex endophyte is present in the formulation in an amount capable of modulating at least one of: a trait of agronomic importance, the transcription of a gene, the expression of a protein, the level of a hormone, the level of a metabolite, and the population of endogenous microbes in plants grown from the seeds, as compared to isoline plants not associated with, or grown from plant elements associated with, the designed complex endophyte.

In some embodiments of the methods described herein, the formulation further comprises one or more of the following: a stabilizer, or a preservative, or a carrier, or a surfactant, or an anticomplex agent, fungicide, nematicide, bactericide, insecticide, and herbicide, or any combination thereof. In some embodiments of the methods described herein, the designed complex endophyte is present in an amount of at least about 10^2 CFU per plant element.

In some embodiments of the methods described herein, the designed complex endophyte comprises a host fungus from a class selected from the group consisting of: Dothideomycetes, Sordariomycetes, Mucoromycotina, Pezizomycotina, or any of the corresponding anamorph or teleomorph taxonomy of the preceding; and/or a bacterium from a class selected from the group consisting of: Bacilli, Gammaproteobacteria, Actinobacteria; and/or a host fungus from an order selected from the group consisting of: Sordariomycetes, Xylariales, Mucorales, Capnodiales, or any of the corresponding anamorph or teleomorph taxonomy of the preceding; and/or a bacterium from an order selected from the group consisting of: Bacillales, Enterobacteriales, Xanthomonadales, Actinomycetales; and/or a host fungus from a family selected from the group consisting of: Mycospharellaceae, Davidiellacea, Mucoraceae, Xylariomycetidae, Amphisphaeriacea, or any of the corresponding anamorph or teleomorph taxonomy of the preceding; and/or a bacterium from a family selected from the group consisting of: Paenibacillaceae, Enterobacteriaceae, Xanthomonadaceae, Streptomycetaceae; and/or a host fungus from a genus selected from the group consisting of: *Pestalotiopsis, Mucor, Cladosporium*, or any of the corresponding anamorph or teleomorph taxonomy of the preceding; and/or a bacterium from a genus selected from the group consisting of: *Pantoea, Paenibacillus, Luteibacter, Streptomyces*; and/or a nucleic acid sequence at least 95% identical to a nucleic acid sequence selected from the group consisting of SEQ ID NO: 1 through SEQ ID NO: 758; and/or is selected from those listed in Table 3; and/or is associated with a plant element but is not directly contacting the plant element; and/or the plant element is selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud; and/or the plant element is from a plant selected from the group consisting of: wheat, soybean, maize, cotton, canola, barley, sorghum, millet, rice, rapeseed, alfalfa, tomato, sugarbeet, sorghum, almond, walnut, apple, peanut, strawberry, lettuce, orange, potato, banana, sugarcane, potato, cassava, mango, guava, palm, onions, olives, peppers, tea, yams, cacao, sunflower, asparagus, carrot, coconut, lemon, lime, barley, watermelon, cabbage, cucumber, grape, and turfgrass.

Also disclosed herein is a plant element from the plant produced by any of the methods described herein.

Also disclosed herein is a method for preparing a synthetic composition, comprising associating the surface of a plurality of plant elements with a formulation comprising a designed complex endophyte, wherein the designed complex endophyte comprises a bacterium within a heterologous fungus and is present in the formulation in an amount capable of modulating at least one of: a trait of agronomic importance, the transcription of a gene, the expression of a protein, the level of a hormone, the level of a metabolite, and the population of endogenous microbes in plants grown from the seeds, as compared to isoline plants not associated with, or grown from plant elements associated with, the formulation.

In some embodiments of the method for preparing a synthetic composition, the trait of agronomic importance is selected from the group consisting of: altered oil content, altered protein content, altered seed carbohydrate composition, altered seed oil composition, altered seed protein composition, increased chemical tolerance, increased cold tolerance, delayed senescence, increased disease resistance, increased drought tolerance, increased ear weight, growth improvement, health enhancement, increased heat tolerance, increased herbicide tolerance, increased herbivore resistance, improved nitrogen fixation, improved nitrogen utilization, improved nutrient use efficiency, improved root architecture, improved water use efficiency, increased biomass, increased root length, increased seedling root length, germination rate, increased seed weight, increased shoot length, increased seedling shoot length, increased shoot biomass, seedling mass, seedling root surface area, increased yield, increased yield under water-limited conditions, increased kernel mass, improved kernel moisture content, increased metal tolerance, increased number of ears, increased number of kernels per ear, increased number of pods, nutrition enhancement, improved pathogen resistance, improved pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased seed germination, increased number of pods per plant, increased length of pods per plant, reduced number of wilted leaves per plant, reduced number of severely wilted leaves per plant, increased number of non-wilted leaves per plant, increased plant height, earlier or increased flowering, increased protein content, increased fermentable carbohydrate content, reduced lignin content, male sterility, and increased antioxidant content; and/or the trait of agronomic importance is selected from the group consisting of: germination rate, emergence rate, shoot biomass, seedling root length, seedling shoot length, seedling mass, seedling root surface area, and yield; and/or the trait of agronomic importance is improved under normal watering conditions; and/or the trait of agronomic importance is improved under conditions of water limitation.

In some embodiments of the method for preparing a synthetic composition, the synthetic composition further comprises an agronomic formulation that further comprises one or more of the following: a stabilizer, or a preservative, or a carrier, or a surfactant, or an anticomplex agent, fungicide, nematicide, bactericide, insecticide, and herbicide, or any combination thereof; and/or the designed complex endophyte is present in an amount of at least about 10^2 CFU per plant element.

In some embodiments of the method for preparing a synthetic composition, the designed complex endophyte comprises a host fungus from a class selected from the group consisting of: Dothideomycetes, Sordariomycetes, Mucoromycotina, Pezizomycotina, or any of the corresponding anamorph or teleomorph taxonomy of the preceding; and/or a bacterium from a class selected from the group consisting of: Bacilli, Gammaproteobacteria, Actinobacteria; and/or a host fungus from an order selected from the group consisting of: Sordariomycetes, Xylariales, Mucorales, Capnodiales, or any of the corresponding anamorph or teleomorph taxonomy of the preceding; and/or a bacterium from an order selected from the group consisting of: Bacillales, Enterobacteriales, Xanthomonadales, Actinobacteria; and/or a host fungus from a family selected from the group consisting of: Mycospharellaceae, Davidiellacea, Mucoraceae, Xylariomycetidae, Amphisphaeriacea, or any of the corresponding anamorph or teleomorph taxonomy of the preceding; and/or a bacterium from a family selected from the group consisting of: Paenibacillaceae, Enterobacteriaceae, Xanthomonadaceae, Streptomycetaceae; and/or a host fungus from a genus selected from the group consisting of:

*Pestalotiopsis, Mucor, Cladosporium*, or any of the corresponding anamorph or teleomorph taxonomy of the preceding; and/or a bacterium from a genus selected from the group consisting of: *Pantoea, Paenibacillus, Luteibacter, Streptomyces*; and/or a nucleic acid sequence at least 95% identical to a nucleic acid sequence selected from the group consisting of SEQ ID NO: 1 through SEQ ID NO: 747; and/or is selected from those listed in Table 3; and/or is associated with a plant element but is not directly contacting the plant element, e.g., is selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud; e.g., and/or is from a plant selected from the group consisting of: wheat, soybean, maize, cotton, canola, barley, sorghum, millet, rice, rapeseed, alfalfa, tomato, sugarbeet, sorghum, almond, walnut, apple, peanut, strawberry, lettuce, orange, potato, banana, sugarcane, potato, cassava, mango, guava, palm, onions, olives, peppers, tea, yams, cacao, sunflower, asparagus, carrot, coconut, lemon, lime, barley, watermelon, cabbage, cucumber, grape, and turfgrass.

Also disclosed herein is a plant element from the plant produced by the methods for preparing a synthetic composition described herein.

Also disclosed herein is a method of improving the efficacy of a bacterial endophyte in an application, comprising utilizing a designed complex endophyte, wherein the designed complex endophyte comprises the bacterial endophyte and a method of improving the efficacy of a fungal endophyte in an application, comprising utilizing a designed complex endophyte, wherein the designed complex endophyte comprises the fungal endophyte.

In some embodiments of the methods of improving the efficacy described herein, the application is selected from the group consisting of: agriculture, plant improvement, water quality improvement, snow or ice production, bioremediation, industrial compound production, pharmaceutical compound production, and production of bioengineered substances. In some embodiments of the methods of improving the efficacy described herein, the application is a production method of a composition belonging to a class of compound selected from the group consisting of: acids, alcohols, amino acids, amylases, antibiotics, biogases, bioplastics, citric acid, enzymes, esters, fatty acids, flavoring agents, glutamic acid, human or animal hormones, human growth hormone, ice, insulin, lactic acid, lipases, lipids, minerals, nitrogen, oils, nucleic acids, pectinases, preservatives, proteins, snow, sugars, vaccines, viruses, vitamins, and waxes.

Also disclosed herein is a method of improving the performance of a bacterial endophyte in an application, comprising synthesizing a designed complex endophyte comprising a bacterium comprising a nucleic acid sequence with at least 95% identity to that of the bacterial endophyte, and substituting the designed complex endophyte for the bacterial endophyte in the application. In some embodiments, the bacterial endophyte is further associated with a plant element; and/or the bacterial endophyte is Gram-negative; and/or the fungal endophyte has improved sporulation capability; and/or the characteristic is selected from the group consisting of: efficacy, survivability, shelf-stability, tolerance to an antibiotic, tolerance to reduced environmental moisture.

DESCRIPTION OF THE DRAWINGS

FIG. 1A and FIG. 1B: Microscopy of native complex endohpytes and their corresponding cured fungal hosts. Microscopy images demonstrate morphological differences between complex endophytes (fungal hosts comprising component bacteria) and those same fungal hosts cured from their component bacteria. Bacterial clustering within endophytic fungus vs. non-clustering of cured fungal hosts: Brightfield (greyscale, left) and single color fluorescence microscopic images of a plate grown with endophytic bacteria containing fungus preparations. Putative bacterial clusters indicated by punctate DNA (right, green) as well as dead cell marker (middle, red) show relative isolation of bacterial signal. Note the filamentus nature of colonies (greyscale, left). FIG. 1A: SYM15779 in its isolated complex endophyte form, and its cured fungal host form (component bacteria removed). Verification of absence of component bacteria status was conducted by incubating the cured fungal host and assessing no emergence of bacteria from the fungal hyphae. FIG. 1B: SYM15890, a non-complex endophytic fungus, and its "cured" fungal host form (surface bacterial contamination removed) after antibiotic treatment.

FIG. 2A, FIG. 2B, FIG. 2C, FIG. 2D, FIG. 2E, FIG. 2F: Designed complex endophyte and endophytic component culture phentoypic characteristics. Each cured fungal host is the plate culture of the isolated complex endophyte after incubation with antibiotics to kill the component bacteria, and replating. Each isolated bacterial component image is the plate culture of the isolated complex endophyte after incubation with cyclohexamide to kill the host fungus, and replating. (Note: holes in cultures are due to sample extractions)

FIG. 3A, FIG. 3B, FIG. 3C, FIG. 3D: Non-complex endophyte fungi and bacteria used in the creation of the designed complex endophytes of the present invention. The following fungus and bacterium strains were not isolated from any isolated complex endophyte, and were cultured separately for use in the designed complex endophyte synthesis experiments. To verify non-complex endophyte status, the fungal endophyte SYM15890 was cultured with and without antibiotics. No differences in plate phenotypes were visible. (Note: holes in cultures are due to sample extractions).

FIG. 8A: Plate cultures of the isolated complex endophyte SYM166, the cured fungal host, the heterologous bacterium SYM257, and the novel designed complex endophyte SYM166+257. (Note: holes in cultures are due to sample extractions). FIG. 8B: PCR verification of 16S and ITS amplification presence/absence in the above samples. Samples were run on 2% agarose gel.

FIG. 9A, FIG. 9B, FIG. 9C: Microscopy of designed complex endophytes. An example of a cured host fungus (SYM15779), and two designed complex endophtyes created with the cured fungal host plus two different heterologous component bacteria (292, EHB166). Microscopy shows clear morphological differences between a cured (empty) fungal host and the designed complex endophytes. Bacterial clustering within the designed complex endophyte vs. non-clustering of cured fungal hosts: Brightfield (greyscale, left) and single color fluorescence microscopic images of a plate grown with endophytic bacteria containing fungus preparations. Putative bacterial clusters indicated by punctate DNA (right, green) as well as dead cell marker (middle, red) show relative isolation of bacterial signal. Note the filamentus nature of colonies (greyscale, left).

FIG. 10: Dried biomass for seed treatments.

FIG. 11A: Day 1 survivability of two different bacterial endophytes in different complex endophyte host fungi, as compared to their corresponding isolated bacteria. FIG. 11B: Day 1 and Day 6 survivability of the bacterium SYM292 can be improved by encapsulating it within a host fungus as part of a designed complex endophyte.

DEFINITIONS

Figure 4:
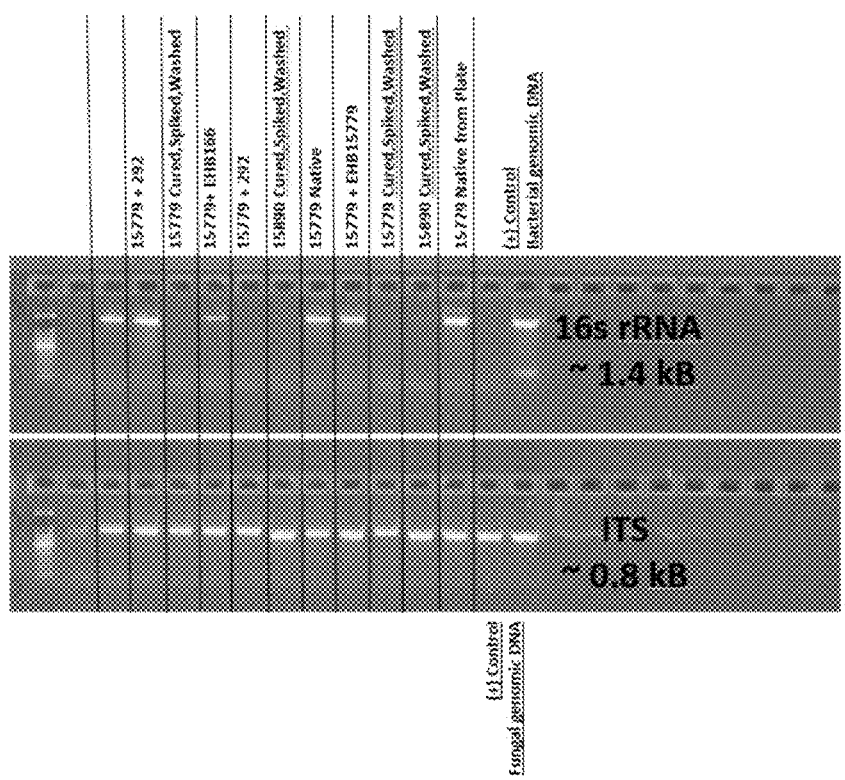
FIG. 4: Verification of designed complex endophyte status. As demonstrated on the gel shown here, the native endofungal endophyte SYM15779 comprises both bacterial and fungal DNA, but when cured using the methodologies described in the Examples, is confirmed to be free of bacterial DNA. Co-culturing of SYM15779 with bacterial strains SYM257 and SYM292 results in both fungal and bacterial strains being present. As a control, a cured SYM15779 sample was spiked with a bacterial strain, but the bacterial strain did not amplify during PCR. From these data it is concluded that the designed complex endophytes SYM15779+EHB166, SYM15779+SYM292, as well as SYM15779+reintroduced EHB15779 all do in fact comprise endofungal bacteria that have been incorporated into the host fungus, vs. being co-present in a non-incorporated state (e.g., present on the surface of the fungus). As another control, SYM15890 was also subjected to antibiotic treatment to "cure" of any endofungal bacteria, spiked with SYM292, and washed, but the bacterial strain did not amplify during PCR, demonstrating the efficacy of the method. Samples were run on 2% agarose gel.

An "endophyte" is an organism that lives within a plant or is otherwise associated therewith, and does not cause disease or harm the plant otherwise. Endophytes can occupy the intracellular or extracellular spaces of plant tissue, including the leaves, stems, flowers, fruits, seeds, or roots. An endophyte can be for example a bacterial or fungal organism, and can confer a beneficial property to the host plant such as an increase in yield, biomass, resistance, or fitness. As used herein, the term "microbe" is sometimes used to describe an endophyte, particularly a fungal endophyte, that may be isolated from a fungal endophyte, and that may be capable of living within a plant.

The term "complex endophyte" is used to describe a host fungus that encompasses at least one additional organism or composition, for example, endofungal bacterial endophytes or endofungal fungal endophytes. The term "designed complex endophyte" is used to describe a host fungus that encompasses at least one additional heterologous organism or composition. In some embodiments, that combination can itself be associated with a plant, for example. Such additional heterologous organism or composition may be, for example, endofungal bacterial endophytes or endofungal fungal endophytes. As used herein, an "endophytic component" refers to an endofungal bacterial endophyte or an endofungal fungal endophyte, whether heterologous to a host fungus or not.

"Endofungal bacterial endophyte" means a bacterial endophyte that is capable of living inside a fungus, for example within the hyphae. The term "endofungal bacterial endophyte" is used to denote bacterial endophytic entities originally isolated from a host fungus or those that are capable of living within a host fungus. Likewise, "endofungal fungal endophyte" means a fungal endophyte originally isolated from a host fungus or one capable of living within a host fungus. In such cases, the term "endofungal" denotes either the source of origin (host fungus) or capability of existing within a host fungus, and is not meant to imply that the bacterium or fungus (or bacteria or fungi), is continually encompassed within a host fungus. For example, an endofungal bacterial endophyte may reside within a host fungus for part of its life cycle and reside external to the host fungus for other parts of its life cycle. In some cases, the term "component bacterium" is used to denote a bacterium that exists within a host fungus, or has been isolated from a host fungus. Within the scope of the present invention, the term "endohyphal" may be considered synonymous with "endofungal".

In some embodiments, the host fungus comprises algae or cyanobacteria, or both, living in symbiosis (lichen), and at least one endofungal bacterial endophyte or endofungal fungal endophyte.

As used herein, the term "capable of" living inside a fungus means that the endophyte has the appropriate features permitting it to live inside a fungus. For example, the endophyte may produce the necessary substances to avoid rejection by the fungus, and be able to use the nutrients provided by the fungus to live.

As used herein, the term "bacterium" or "bacteria" refers in general to any prokaryotic organism, and may reference an organism from either Kingdom Eubacteria (Bacteria), Kingdom Archaebacteria (Archae), or both. In some cases, bacterial genera have been reassigned due to various reasons (such as but not limited to the evolving field of whole genome sequencing), and it is understood that such nomenclature reassignments are within the scope of any claimed genus. For example, certain species of the genus *Erwinia* have been described in the literature as belonging to genus *Pantoea* (Zhang and Qiu, 2015).

The term 16S refers to the DNA sequence of the 16S ribosomal RNA (rRNA) sequence of a bacterium. 16S rRNA gene sequencing is a well-established method for studying phylogeny and taxonomy of bacteria.

As used herein, the term "fungus" or "fungi" refers in general to any organism from Kingdom Fungi. Historical taxonomic classification of fungi has been according to morphological presentation. Beginning in the mid-1800's, it was became recognized that some fungi have a pleomorphic life cycle, and that different nomenclature designations were being used for different forms of the same fungus. In 1981, the Sydney Congress of the International Mycological Association laid out rules for the naming of fungi according to their status as anamorph, teleomorph, or holomorph (Taylor, 2011). With the development of genomic sequencing, it became evident that taxonomic classification based on molecular phylogenetics did not align with morphological-based nomenclature (Shenoy, 2007). As a result, in 2011 the International Botanical Congress adopted a resolution approving the International Code of Nomenclature for Algae, Fungi, and Plants (Melbourne Code) (2012), with the stated outcome of designating "One Fungus=One Name" (Hawksworth, 2012). However, systematics experts have not aligned on common nomenclature for all fungi, nor are all existing databases and information resources inclusive of updated taxonomies. As such, many fungi referenced herein may be described by their anamorph form but it is understood that based on identical genomic sequencing, any pleomorphic state of that fungus may be considered to be the same organism. For example, the genus *Alternaria* is the anamorph form of the teleomorph genus Lewia (Kwasna 2003), ergo both would be understood to be the same organism with the same DNA sequence. For example, it is understood that the genus *Acremonium* is also reported in the literature as genus *Sarocladium* as well as genus *Tilachilidium* (Summerbell, 2011). For example, the genus *Cladosporium* is an anamorph of the teleomorph genus *Davidiella* (Bensch, 2012), and is understood to describe the same organism. In some cases, fungal genera have been reassigned due to various reasons, and it is understood that such nomenclature reassignments are within the scope of any claimed genus. For example, certain species of the genus *Microdiplodia* have been described in the literature as belonging to genus *Paraconiothyrium* (Crous and Groenveld, 2006).

"Internal Transcribed Spacer" (ITS) refers to the spacer DNA (non-coding DNA) situated between the small-subunit ribosomal RNA (rRNA) and large-subunit (LSU) rRNA genes in the chromosome or the corresponding transcribed region in the polycistronic rRNA precursor transcript. ITS gene sequencing is a well-established method for studying phylogeny and taxonomy of fungi. In some cases, the "Large SubUnit" (LSU) sequence is used to identify fungi. LSU gene sequencing is a well-established method for studying phylogeny and taxonomy of fungi. Some fungal endophytes of the present invention may be described by an ITS sequence and some may be described by an LSU sequence. Both are understood to be equally descriptive and accurate for determining taxonomy.

The terms "pathogen" and "pathogenic" in reference to a bacterium or fungus includes any such organism that is capable of causing or affecting a disease, disorder or condition of a host comprising the organism.

A "spore" or a population of "spores" refers to bacteria or fungi that are generally viable, more resistant to environmental influences such as heat and bactericidal or fungicidal agents than other forms of the same bacteria or fungi, and typically capable of germination and out-growth. Bacteria and fungi that are "capable of forming spores" are those bacteria and fungi comprising the genes and other necessary abilities to produce spores under suitable environmental conditions.

"Biomass" means the total mass or weight (fresh or dry), at a given time, of a plant tissue, plant tissues, an entire plant, or population of plants. Biomass is usually given as weight per unit area. The term may also refer to all the plants or species in the community (community biomass).

The term "isolated" is intended to specifically reference an organism, cell, tissue, polynucleotide, or polypeptide that is removed from its original source and purified from additional components with which it was originally associated. For example, a designed complex endophyte may be considered isolated from a seed if it is removed from that seed source and purified so that it is isolated from any additional components with which it was originally associated. Similarly, a designed complex endophyte may be removed and purified from a plant or plant element so that it is isolated and no longer associated with its source plant or plant element. In some cases, the term "isolated" is used to describe a bacterium of a designed complex endophyte that has been removed from its host fungus A "host plant" includes any plant, particularly a plant of agronomic importance, which a designed complex endophyte can colonize. As used herein, an endophyte is said to "colonize" a plant or seed when it can be stably detected within the plant or seed over a period time, such as one or more days, weeks, months or years, in other words, a colonizing entity is not transiently associated with the plant or seed. In some embodiments, such host plants are plants of agronomic importance.

A "non-host target" means an organism or chemical compound that is altered in some way after contacting a host plant or host fungus that comprises an endophyte, as a result of a property conferred to the host plant or host fungus by the endophyte.

As used herein, a nucleic acid has "homology" or is "homologous" to a second nucleic acid if the nucleic acid sequence has a similar sequence to the second nucleic acid sequence. The terms "identity," "percent sequence identity" or "identical" in the context of nucleic acid sequences refer to the residues in the two sequences that are the same when aligned for maximum correspondence. There are a number of different algorithms known in the art that can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. (Pearson, 1990, Methods Enzymol. 183: 63-98, incorporated herein by reference in its entirety). The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% 99%, 99.5% or 100% of the nucleotide bases, as measured by any well-known algorithm of sequence identity, such as FASTA, BLAST or Gap, as discussed above. In some embodiments, sequences can be compared using Geneious (Biomatters, Ltd., Auckland, New Zealand). In other embodiments, polynucleotide sequences can be compared using the multiple sequence alignment algorithm MUSCLE (Edgar R C, 2004).

As used herein, the terms "operational taxonomic unit," "OTU," "taxon," "hierarchical cluster," and "cluster" are used interchangeably. An operational taxon unit (OTU) refers to a group of one or more organisms that comprises a node in a clustering tree. The level of a cluster is determined by its hierarchical order. In one embodiment, an OTU is a group tentatively assumed to be a valid taxon for purposes of phylogenetic analysis. In another embodiment, an OTU is any of the extant taxonomic units under study. In yet another embodiment, an OTU is given a name and a rank. For example, an OTU can represent a domain, a sub-domain, a kingdom, a sub-kingdom, a phylum, a sub-phylum, a class, a sub-class, an order, a sub-order, a family, a subfamily, a genus, a subgenus, or a species. In some embodiments, OTUs can represent one or more organisms from the kingdoms eubacteria, protista, or fungi at any level of a hierarchal order. In some embodiments, an OTU represents a prokaryotic or fungal order.

In some embodiments, the invention uses endophytes that are heterologous to a plant element, for example in making synthetic combinations or agricultural formulations. A microbe is considered heterologous to the seed or plant if the seed or seedling that is unmodified (e.g., a seed or seedling that is not treated with an endophyte population described herein) does not contain detectable levels of the microbe. For example, the invention contemplates the synthetic combinations of seeds or seedlings of agricultural plants and an endophytic microbe population (e.g., an isolated bacterium), in which the microbe population is "heterologously disposed" on the exterior surface of or within a tissue of the agricultural seed or seedling in an amount effective to colonize the plant. A microbe is considered "heterologously disposed" on the surface or within a plant (or tissue) when the microbe is applied or disposed on the plant in a number that is not found on that plant before application of the microbe. For example, an endophyte population that is disposed on an exterior surface or within the seed can be an endophytic bacterium that may be associated with the mature plant, but is not found on the surface of or within the seed. As such, a microbe is deemed heterologously disposed when applied on the plant that either does not naturally have the microbe on its surface or within the particular tissue to which the microbe is disposed, or does not naturally have the microbe on its surface or within the particular tissue in the number that is being applied. In another example, an endophyte that is normally associated with leaf tissue of a cupressaceous tree sample would be considered heterologous to leaf tissue of a maize plant. In another example, an endophyte that is normally associated with leaf tissue of a maize plant is considered heterologous to a leaf tissue of another maize plant that naturally lacks said endophyte. In another example, a designed complex endophyte that is normally associated at low levels in a plant is considered heterologous to that plant if a higher concentration of that endophyte is introduced into the plant.

In some embodiments, a microbe can be "endogenous" to a seed or plant, or a bacterium may be "endogenous" to a fungal host with which it forms a designed complex endophyte. As used herein, a microbe is considered "endogenous" to a plant or seed, if the endophyte or endophyte component is derived from, or is otherwise found in, a plant element of the plant specimen from which it is sourced. Further, an endophyte is considered "endogenous" to a fungal host, if the endophyte is derived from, or is otherwise found in, a fungal host. For example, a designed complex endophyte may be isolated and purified, said designed complex endophyte comprising a host fungus and an endogenous bacterium.

The term "isoline" is a comparative term, and references organisms that are genetically identical, but may differ in treatment. In one example, two genetically identical maize plant embryos may be separated into two different groups, one receiving a treatment (such as transformation with a heterologous polynucleotide, to create a genetically modified plant) and one control that does not receive such treatment. Any phenotypic differences between the two groups may thus be attributed solely to the treatment and not to any inherency of the plant's genetic makeup. In another example, two genetically identical soybean seeds may be treated with a formulation that introduces an endophyte composition. Any phenotypic differences between the plants grown from those seeds may be attributed to the treatment, thus forming an isoline comparison.

Similarly, by the term "reference agricultural plant", it is meant an agricultural plant of the same species, strain, or cultivar to which a treatment, formulation, composition or endophyte preparation as described herein is not administered/contacted. A reference agricultural plant, therefore, is identical to the treated plant with the exception of the presence of the endophyte and can serve as a control for detecting the effects of the endophyte that is conferred to the plant.

A "reference environment" refers to the environment, treatment or condition of the plant in which a measurement is made. For example, production of a compound in a plant associated with an endophyte can be measured in a reference environment of drought stress, and compared with the levels of the compound in a reference agricultural plant under the same conditions of drought stress. Alternatively, the levels of a compound in plant associated with an endophyte and reference agricultural plant can be measured under identical conditions of no stress.

A "plant element" is intended to generically reference either a whole plant or a plant component, including but not limited to plant tissues, parts, and cell types. A plant element may be one of the following: whole plant, seedling, meristematic tissue, ground tissue, vascular tissue, dermal tissue, seed, leaf, root, shoot, stem, flower, fruit, stolon, bulb, tuber, corm, kelkis, shoot, bud. As used herein, a "plant element" is synonymous to a "portion" of a plant, and refers to any part of the plant, and can include distinct tissues and/or organs, and may be used interchangeably with the term "tissue" throughout.

Similarly, a "plant reproductive element" is intended to generically reference any part of a plant that is able to initiate other plants via either sexual or asexual reproduction of that plant, for example but not limited to: seed, seedling, root, shoot, stolon, bulb, tuber, corm, keikis, or bud.

A "progeny seed", as used herein, refers to the seed produced by a host plant that has been inoculated with, or associated with, an endophyte. For example, in the present invention, a seed, plant element, or whole plant may become heterologously associated with an endophyte, and the plant that is grown from said seed, or plant that is grown in heterologous association with said endophyte, may itself produce progeny seeds that comprise altered nutritional composition compared to seeds obtained from plants that were not grown from a plant element associated with an endophyte or obtained from a parental (host) plant that had become associated with an endophyte at some point in its life cycle. In the general sense, the phrase "progeny seed" may be construed to represent any plant propagative unit produced by the host plant that is capable of becoming another individual of that same plant species.

A "population" of plants, as used herein, can refer to a plurality of plants that were subjected to the same inoculation methods described herein, or a plurality of plants that are progeny of a plant or group of plants that were subjected to the inoculation methods. In addition, a population of plants can be a group of plants that are grown from coated seeds. The plants within a population will typically be of the same species, and will also typically share a common genetic derivation.

As used herein, an "agricultural seed" is a seed used to grow a plant typically used in agriculture (an "agricultural plant"). The seed may be of a monocot or dicot plant, and may be planted for the production of an agricultural product, for example feed, food, fiber, fuel, etc. As used herein, an agricultural seed is a seed that is prepared for planting, for example, in farms for growing.

The term "synthetic combination" means a plurality of elements associated by human endeavor, in which said association is not found in nature. In the present invention, "synthetic combination" is used to refer to a treatment formulation associated with a plant element.

A "treatment formulation" refers to a mixture of chemicals that facilitate the stability, storage, and/or application of the endophyte composition(s). In some embodiments, an agriculturally compatible carrier can be used to formulate an agricultural formulation or other composition that includes a purified endophyte preparation. As used herein an "agriculturally compatible carrier" refers to any material, other than water, that can be added to a plant element without causing or having an adverse effect on the plant element (e.g., reducing seed germination) or the plant that grows from the plant element, or the like.

The compositions and methods herein may provide for an improved "agronomic trait" or "trait of agronomic importance" to a host plant, which may include, but not be limited to, the following: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutritional quality trait, compared to an isoline plant grown from a seed without said seed treatment formulation.

The phrase "nutritional quality trait" includes any measureable parameter of a seed that either directly or indirectly influences the value (nutritional or economic) of said seed, for example, but not limited to: protein, fat, carbohydrate, ash, moisture, fiber, and Calories. In some cases, "nutritional quality trait" is synonymous with "nutritional quality trait" or "seed nutritional quality trait", and can refer to any composition of the associated plant element, most particularly compositions providing benefit to other organisms that consume or utilize said plant element.

As used herein, the terms "water-limited (or water-limiting) condition" and "drought condition", or "water-limited" and "drought", or "water stress" and "drought stress", may all be used interchangeably. For example, a method or composition for improving a plant's ability to grown under drought conditions means the same as the ability to grow under water-limited conditions. In such cases, the plant can be further said to display improved drought tolerance.

Additionally, "altered metabolic function" or "altered enzymatic function" may include, but not be limited to, the following: altered production of an auxin, altered nitrogen fixation, altered production of an antimicrobial compound, altered production of a siderophore, altered mineral phosphate solubilization, altered production of a cellulase, altered production of a chitinase, altered production of a xylanase, altered production of acetoin.

An "increased yield" can refer to any increase in biomass or seed or fruit weight, seed size, seed number per plant, seed number per unit area, bushels per acre, tons per acre, kilo per hectare, or carbohydrate yield. Typically, the particular characteristic is designated when referring to increased yield, e.g., increased grain yield or increased seed size.

In some cases, the present invention contemplates the use of compositions that are "compatible" with agricultural chemicals, for example, a fungicide, an anti-complex compound, or any other agent widely used in agricultural which has the effect of killing or otherwise interfering with optimal growth of another organism. As used herein, a composition is "compatible" with an agricultural chemical when the organism is modified, such as by genetic modification, e.g., contains a transgene that confers resistance to an herbicide, or is adapted to grow in, or otherwise survive, the concentration of the agricultural chemical used in agriculture. For example, an endophyte disposed on the surface of a seed is compatible with the fungicide metalaxyl if it is able to survive the concentrations that are applied on the seed surface.

As used herein, a "colony-forming unit" ("CFU") is used as a measure of viable microorganisms in a sample. A CFU is an individual viable cell capable of forming on a solid medium a visible colony whose individual cells are derived by cell division from one parental cell.

The term "efficacy" (and its synonyms, such as "efficacious") as used herein describes the capability of a microbe to perform its function. In one non-limiting example, a designed complex endophyte is said to be efficacious if it is capable of performing a function such as improving the yield of a plant with which it becomes associated. In another non-limiting example, a bacterial endophyte is said to display improved efficacy if it is capable of performing a particular function under one condition vs. a control condition.

The terms "decreased", "fewer", "slower" and "increased" "faster" "enhanced" "greater" as used herein refers to a decrease or increase in a characteristic of the endophyte treated seed or resulting plant compared to an untreated seed or resulting plant. For example, a decrease in a characteristic may be at least 1%, between 1% and 2%, at least 2%, between 2% and 3%, at least 3%, between 3% and 4%, at least 4%, between 4% and 5%, at least 5%, between 5% and 10%, at least 10%, between 10% and 15%, at least 15%, between 15% and 20%, at least 20%, between 20% and 25%, at least 25%, between 25% and 30%, at least 30%, between 30% and 35%, at least 35%, between 35% and 40%, at least 40%, between 40% and 45%, at least 45%, between 45% and 50%, at least 50%, between 50% and 60%, at least about 60%, between 60% and 75%, at least 75%, between 75% and 80%, at least about 80%, between 80% and 90%, at least about 90%, between 90% and 100%, at least 100%, between 100% and 200%, at least 200%, between 200% and 300%, at least about 300%, between 300% and 400%, at least about 400% or more lower than the untreated control, and an increase may be at least 1%, between 1% and 2%, at least 2%, between 2% and 3%, at least 3%, between 3% and 4%, at least 4%, between 4% and 5%, at least 5%, between 5% and 10%, at least 10%, between 10% and 15%, at least 15%, between 15% and 20%, at least 20%, between 20% and 25%, at least 25%, between 25% and 30%, at least 30%, between 30% and 35%, at least 35%, between 35% and 40%, at least 40%, between 40% and 45%, at least 45%, between 45% and 50%, at least 50%, between 50% and 60%, at least about 60%, between 60% and 75%, at least 75%, between 75% and 80%, at least about 80%, between 80% and 90%, at least about 90%, between 90% and 100%, at least 100%, between 100% and 200%, at least 200%, between 200% and 300%, at least about 300%, between 300% and 400%, at least about 400% or more higher than the untreated control.

DETAILED DESCRIPTION OF THE INVENTION

As demonstrated herein, agricultural plants associate with symbiotic microorganisms termed endophytes, particularly bacteria and fungi, which may contribute to plant survival and performance. However, modern agricultural processes may have perturbed this relationship, resulting in increased crop losses, diminished stress resilience, biodiversity losses, and increasing dependence on external chemicals, fertilizers, and other unsustainable agricultural practices. There is a need for novel methods for generating plants with novel microbiome properties that can sustainably increase yield, stress resilience, and decrease fertilizer and chemical use.

Given the variable natures of different strains of bacteria, there also exists a great need for novel methods of improving the survivability and efficacy of bacterial microbes, for use in agriculture and other fields. Given the variable natures of different strains of fungi, there also exists a great need for novel methods of improving the survivability and efficacy of fungal microbes, for use in agriculture and other fields.

Currently, the generally accepted view of plant endophytic communities focuses on their homologous derivation, predominantly from the soil communities in which the plants are grown (Hallman et al., (1997) Canadian Journal of Microbiology. 43(10): 895-914). Upon observing taxonomic overlap between the endophytic and soil microbiota in *A. thaliana*, it was stated, "Our rigorous definition of an endophytic compartment microbiome should facilitate controlled dissection of plant-microbe interactions derived from complex soil communities" (Lundberg et al., (2012) Nature. 488, 86-90). There is strong support in the art for soil representing the repository from which plant endophytes are derived (Long et al., 2010, New Phytologist 185: 554-567, incorporated herein by reference in its entirety). Notable plant-microbe interactions such as mycorrhyzal fungi and complex rhizobia fit the paradigm of soil-based colonization of plant hosts and appear to primarily establish themselves independently of seed. As a result of focusing attention on the derivation of endophytes from the soil in which the target agricultural plant is currently growing, there has been an inability to achieve commercially significant improvements in plant yields and other plant characteristics such as increased root biomass, increased root length, increased height, increased shoot length, increased leaf number, increased water use efficiency, increased overall biomass, increase grain yield, increased photosynthesis rate, increased tolerance to drought, increased heat tolerance, increased salt tolerance, increased resistance to insect and nematode stresses, increased resistance to a fungal pathogen, increased resistance to a complex pathogen, increased resistance to a viral pathogen, a detectable modulation in the level of a metabolite, and a detectable modulation in the proteome relative to a reference plant.

The inventors herein have conceived of designing and creating novel designed complex endophyte compositions. In some embodiments, these designed complex endophyte compositions may be used to benefit plant health and stress tolerance, as well as methods of using said designed complex endophyte compositions, and methods of using novel designed complex endophyte compositions to impart novel characteristics to a host fungus or an endofungal bacterium. In one aspect, this invention provides designed combinations of endophytic entities, particularly host fungi comprising heterologous bacteria or host fungi comprising a second heterologous fungus, said combinations not found in nature. In some embodiments, these designed complex endophytes may be combined synthetically with a plant element, such as a seed, to impart improved agronomic potential and/or improved agronomic traits to the host plant. In one aspect of this invention, designed endophyte compositions are synthetically combined with a plant element, such as a seed, to impart improved agronomic potential and/or improved agronomic traits to the host plant. In another aspect of the invention, endophytic fungal components, such as endofungal bacteria or endofungal fungi, are isolated and purified from their native source(s) and synthetically combined with each other to form novel designed complex endophytes, which are then combined with a plant element, to impart improved agronomic potential and/or improved agronomic traits to the host plant. Such designed complex endophytes may be further manipulated or combined with additional elements prior to combining with the plant element(s).

As described herein, beneficial organisms can be robustly derived from heterologous, endogenous, or engineered sources, optionally cultured, administered heterologously to plant elements, and, as a result of the administration, confer multiple beneficial properties. This is surprising given the variability observed in the art in endophytic microbe isolation and the previous observations of inefficient seed pathogen colonization of plant host's tissues. Further, the ability of heterologously disposed designed complex endophytes to colonize plant reproductive elements from the outside is surprising, given that isolated designed complex endophytes have not been previously demonstrated to be capable of penetrating and colonizing host tissues.

In part, the present invention describes preparations of designed complex endophytes, and the creation of synthetic combinations of seeds and/or seedlings with heterologous designed complex endophyte compositions, and formulations comprising the synthetic combinations, as well as the recognition that such synthetic combinations display a diversity of beneficial properties present in the agricultural plants and the associated designed complex endophyte populations newly created by the present inventors. Such beneficial properties include metabolism, transcript expression, proteome alterations, morphology, and the resilience to a variety of environmental stresses, and the combination of a plurality of such properties. The present invention also describes methods of using such designed complex endophyte compositions to benefit the host plant with which it is associated. Additionally, the present invention also describes methods of introducing a heterologous component into a fungus to create a designed complex endophyte, as well as methods of associating said designed complex endophyte with a plant element to effect a phenotypic change in a host plant. Additionally, the present invention also describes methods of improving the survivability and efficacy of bacteria for various applications, by encapsulating them in fungal hosts.

Designed Complex Endophyte Compositions and Methods of Making

The designed complex endophytes described herein provide several advantages over naturally-sourced endophytes. Bacteria and fungi normally found in one type of environment may impart an unexpected benefit to a plant found in a different type of environment. Changing agricultural conditions in one area, for example due to climate change, may render native plants susceptible to stresses, diseases, and/or pests to which those plants have not yet adapted. Introduction of a heterologous endophyte may impart a phenotypic advantage to plants comprising the endophyte.

In some embodiments, this invention relates to endophytic components, such as bacteria and fungi, that are isolated from naturally-occurring complex endophytes from sources other than naturally-occurring endophytes, and artificially introduced into a host fungus to create a novel, and artificially introduced into a host fungus to create a novel designed complex endophyte. In some embodiments, the endophytic component is isolated from a non-plant source, for example, a fungus or a lichen.

In some embodiments, this invention relates to the usage of a fungus as a carrier of an endophytic entity, and methods of creating and using said fungus. In such cases, the fungus can act as a protective mechanism for an endophyte, such as a bacterium or another fungus. For example, it may be desirable to introduce an endophytic bacterium or an endophytic fungus to a plant element in such a manner that it is protected from desiccation, mechanical trauma, or chemical exposure. In another example, it may be useful to introduce a non-spore forming endophytic fungus to a plant element within a host spore-forming fungus. Therefore, one aspect of this invention is a fungus that acts as an endophytic carrier.

In one aspect of the present invention, a fungus to be used as a carrier of a composition for introduction to a plant host, or a fungus to be utilized as a future host of an endofungal component to create a novel designed complex endophyte, may be obtained by removing natively-associated endofungal bacterial endophyte components.

It is also contemplated that a lichen or lichenized fungus could be utilized as a host organism in an endophytic complex. The lichen-associated bacteria, cyanobacteria, and/or fungus can be used as endophytes, either as a complex or individually. The lichen itself may also be utilized as a carrier of endophytic components: for example, a lichen may be used to transfer an endophytic bacterium to a plant element.

In some embodiments, the endophytic component is isolated from a plant source. In one aspect of the present invention, endophytic components useful for the present invention can be isolated from plants or plant elements adapted to a particular environment, including, but not limited to, an environment with water deficiency, salinity, acute and/or chronic heat stress, acute and/or chronic cold stress, nutrient deprived soils including, but not limited to, micronutrient deprived soils, macronutrient (e.g., potassium, phosphate, nitrogen) deprived soils, pathogen stress, including fungal, nematode, insect, viral, complex pathogen stress.

In one aspect of the present invention, the endophytic components useful for the present invention can also be isolated from plants or plant elements adapted to a particular environment, including, but not limited to, an environment with water deficiency, salinity, acute and/or chronic heat stress, acute and/or chronic cold stress, nutrient deprived soils including, but not limited to, micronutrient deprived soils, macronutrient (e.g., potassium, phosphate, nitrogen) deprived soils, pathogen stress, including fungal, nematode, insect, viral, complex pathogen stress.

In one embodiment, a plant comprising an endophytic component is harvested from a soil type different than that in which the plant is normally grown. In another embodiment, the plant comprising an endophytic component is harvested from an ecosystem where the agricultural plant is not normally found. In another embodiment, the plant comprising an endophytic component is harvested from a soil with an average pH range that is different from the optimal soil pH range of the agricultural plant. In one embodiment, the plant comprising an endophytic component is harvested from an environment with average air temperatures lower than the normal growing temperature of the agricultural plant. In one embodiment, the plant comprising an endophytic component is harvested from an environment with average air temperatures higher than the normal growing temperature of the agricultural plant. In another embodiment, the plant comprising an endophytic component is harvested from an environment with average rainfall lower than the optimal average rainfall received by the agricultural plant. In one embodiment, the plant comprising an endophytic component is harvested from an environment with average rainfall higher than the optimal average rainfall of the agricultural plant. In another embodiment, the plant comprising an endophytic component is harvested from a soil type with different soil moisture classification than the normal soil type that the agricultural plant is grown on. In one embodiment, the plant comprising an endophytic component is harvested from an environment with average rainfall lower than the optimal average rainfall of the agricultural plant. In one embodiment, the plant comprising an endophytic component is harvested from an environment with average rainfall higher than the optimal average rainfall of the agricultural plant. In another embodiment, the plant comprising an endophytic component is harvested from an agricultural environment with a yield lower than the average yield expected from the agricultural plant grown under average cultivation practices on normal agricultural land. In another embodiment, the plant comprising an endophytic component is harvested from an agricultural environment with a yield lower than the average yield expected from the agricultural plant grown under average cultivation practices on normal agricultural land. In another embodiment, the plant comprising an endophytic component is harvested from an environment with average yield higher than the optimal average yield of the agricultural plant. In another embodiment, the plant comprising an endophytic component is harvested from an environment with average yield higher than the optimal average yield of the agricultural plant. In another embodiment, the plant comprising an endophytic component is harvested from an environment where soil contains lower total nitrogen than the optimum levels recommended in order to achieve average yields for a plant grown under average cultivation practices on normal agricultural land. In another embodiment, the plant comprising an endophytic component is harvested from an environment where soil contains higher total nitrogen than the optimum levels recommended in order to achieve average yields for a plant grown under average cultivation practices on normal agricultural land. In another embodiment, the plant comprising an endophytic component is harvested from an environment where soil contains lower total phosphorus than the optimum levels recommended in order to achieve average yields for a plant grown under average cultivation practices on normal agricultural land. In another embodiment, the plant comprising an endophytic component is harvested from an environment where soil contains higher total phosphorus than the optimum levels recommended in order to achieve average yields for a plant grown under average cultivation practices on normal agricultural land. In another embodiment, the plant comprising a designed complex endophyte component is harvested from an environment where soil contains lower total potassium than the optimum levels recommended in order to achieve average yields for a plant grown under average cultivation practices on normal agricultural land. In another embodiment, the plant comprising an endophytic component is harvested from an environment where soil contains higher total potassium than the optimum levels recommended in order to achieve average yields for a plant grown under average cultivation practices on normal agricultural land. In another embodiment, the plant comprising an endophytic component is harvested from an environment where soil contains lower total sulfur than the optimum levels recommended in order to achieve average yields for a plant grown under average cultivation practices on normal agricultural land. In another embodiment, the plant comprising an endophytic component is harvested from an environment where soil contains higher total sulfur than the optimum levels recommended in order to achieve average yields for a plant grown under average cultivation practices on normal agricultural land. In another embodiment, the plant comprising an endophytic component is harvested from an environment where soil contains lower total calcium than the optimum levels recommended in order to achieve average yields for a plant grown under average cultivation practices on normal agricultural land. In another embodiment, the plant comprising an endophytic component is harvested from an environment where soil contains lower total magnesium than the optimum levels recommended in order to achieve average yields for a plant grown under average cultivation practices on normal agricultural land. In another embodiment, the plant comprising an endophytic component is harvested from an environment where soil contains higher total sodium chloride (salt) than the optimum levels recommended in order to achieve average yields for a plant grown under average cultivation practices on normal agricultural land.

In some embodiments, this invention relates to purified isolated microbial populations from which endophytic components are derived, that comprise either simple endophytes or designed complex endophytes from, for example, maize, wheat, rice, barley, soybeans, cotton, canola, tomatoes, other agricultural plants, or grasses; compositions such as agricultural formulations or articles of manufacture that include such purified populations, as well as methods of using such populations to make synthetic combinations or agricultural products. In preferred embodiments, this invention relates to designed fungal populations that comprise an endofungal bacterial endophyte or an endofungal fungal endophyte that has been artificially introduced into the host fungus.

In preferred embodiments, this invention relates to designed fungal populations that comprise an endofungal bacterial endophyte or an endofungal fungal endophyte that has been artificially introduced into the host fungus.

In some embodiments, this invention relates to the usage of a fungus as a carrier of an endophyte, and methods of creating and using said fungus. In such cases, the fungus can act as a protective mechanism for an endophyte, such as a bacterium or another fungus, that otherwise has low survivability in a formulation. Gram-negative bacteria, for example, do not survive well when used to treat plant elements. It may be desirable to introduce an endophytic bacterium, or an endophytic fungus, within a host fungus to a plant element in such a manner that the beneficial endophytic bacterium or fungus is protected from dessication, mechanical trauma, or chemical exposure. In another embodiment, this invention relates to the usage of a fungus to deploy a non-spore forming bacterium or fungus. In another embodiment, this invention relates to the usage of a fungus to deploy a crystal protein producing bacterium. Therefore, one aspect of this invention is a fungus that acts as an endophytic carrier to enable deployment of beneficial bacteria or fungi that could otherwise not be turned into a product.

It is also contemplated that a lichen or lichenized fungus could be a host organism in an endophytic complex. The lichen-associated bacteria, cyanobacteria, and/or fungus can be used as endophytes, either as a complex or individually.

It is also contemplated that a lichen or lichenized fungus could be utilized as a host organism in an endophytic complex. The lichen-associated bacteria, cyanobacteria, and/or fungus can be used as endophytes, either as a complex or individually. The lichen itself may also be utilized as a carrier of endophytic components: for example, a lichen may be used to transfer an endophytic bacterium to a plant element.

Components of a designed complex endophyte, used in a combination or individually to make a synthetic composition, can also be obtained from a plant element of many distinct plants. In one embodiment, the endophytic component can be obtained from a plant element of the same or different crop, and can be from the same or different cultivar or variety as the plant element to which the composition is intended to be association.

In another embodiment, components of a designed complex endophyte, used in a composition or used to make a synthetic composition, can be obtained from the same cultivar or species of agricultural plant to which the composition is intended for association, or can be obtained from a different cultivar or species of agricultural plant. For example, a component from a particular corn variety can be isolated, artificially introduced into a different host fungus, and coated onto the surface of a corn seed of the same variety.

In another embodiment, components of a designed complex endophyte, used in a composition or used to make a synthetic composition, can be obtained from a plant element of a plant that is related to the plant element to which the composition is intended to be associated. For example, an component isolated from *Triticum monococcum* (einkorn wheat) can be coated onto the surface of a *T. aestivum* (common wheat) seed; or, an component from *Hordeum vulgare* (barley) can be isolated, artificially introduced into a host fungus, and coated onto the seed of a member of the Triticeae family, for example, seeds of the rye plant, *Secale cereale*.

In still another embodiment, components of a designed complex endophyte, used in a composition or used to make a synthetic composition with a plant element, can be obtained from a plant element of a plant that is distantly related to the plant element with which the endophyte is to be associated. For example, a tomato-derived designed complex endophyte component can be isolated, artificially introduced into a host fungus, and coated onto a rice seed.

In some embodiments, a purified synthetic composition is used that includes two or more (e.g., 3, 4, 5, 6, 7, 8, 9, 10, between 10 and 15, 15, between 15 and 20, 20, between 20 and 25, 25, or greater than 25) different designed complex endophytes or different endophytic components within one host fungus. In each case, the endophytic components may be obtained from different families or different genera, or from the same genera but different species. The different endophytic components can be obtained from the same cultivar of agricultural plant (e.g., the same maize, wheat, rice, or barley plant), different cultivars of the same agricultural plant (e.g., two or more cultivars of maize, two or more cultivars of wheat, two or more cultivars of rice, or two or more cultivars of barley), or different species of the same type of agricultural plant (e.g., two or more different species of maize, two or more different species of wheat, two or more different species of rice, or two or more different species of barley). In embodiments in which two or more designed complex endophytes are used or two or more endophytic components within one host fungus, each of the endophytes can have different properties or activities, e.g., produce different metabolites, produce different enzymes such as different hydrolytic enzymes, confer different beneficial traits, or colonize different elements of a plant (e.g., leaves, stems, flowers, fruits, seeds, or roots). For example, one endophyte can colonize a first tissue and a second endophyte can colonize a tissue that differs from the first tissue. Combinations of endophytes are disclosed in detail below.

In one embodiment, the endophytic component is a microbe isolated from a different plant than the inoculated plant. For example, in one embodiment, the microbe is an endophyte isolated from a different plant of the same species as the inoculated plant. In some cases, the endophyte is isolated from a species related to the inoculated plant.

In some embodiments, the designed complex endophyte comprises an fungus of one or more of the following taxa: *Acremonium, Alternaria, Aspergillus, Aureobasidium, Biscogniauxia, Botryosphaeria, Botrytis, Bullera, Cercospora, Chaetothyriales, Cladosporium, Cochliobolus, Coniothyrium, Cryptococcus, Cryptococcus* unclassified, *Davidiella, Dioszegia, Dothideales, Dothideomycetes, Epicoccum, Erysiphe, Erythrobasidium, Fusarium, Gibberella, Hannaella, Hormonema, Hypoxylon, Lecythophora, Leptospora, Lewia, Monodictys, Monographella, Mucor, Nectria, Neurospora, Paraconiothyrium, Parastagonospora, Penicillium, Periconia, Pestalotiopsis, Phaeomoniella, Phoma, Phyllosticta, Pichia, Pleosporales, Preussia, Rhizopus, Rhodosporidium, Sordariomycetes, Sporobolomyces, Sporormiaceae, Stagonospora, Udeniomyces, Wallemia, Xylaria.*

In some embodiments, the designed complex endophyte comprises a host fungus chosen among those listed in Table 2, or those comprising a fungal ITS or LSU nucleic acid sequence that is at least 97% identical to at least one of the ITS or LSU nucleic acid sequences of the fungi listed in Table 2 (SEQ ID NOs: 561-758).

In some embodiments, the designed complex endophyte comprises a fungus from the genus *Cladosporium*. In some embodiments, the designed complex endophyte comprises an ITS nucleic acid sequence that is at least 97% identical to a sequence selected from the group consisting of SEQ ID NOs: 576, 613, 615, 622, 629, 666, 684, 692, 694, and 757.

In some embodiments, the designed complex endophyte comprises a fungus from the genus *Mucor*. In some embodiments, the designed complex endophyte comprises an ITS nucleic acid sequence that is at least 97% identical to SEQ ID NO: 756.

In some embodiments, the designed complex endophyte comprises a fungus from the genus *Pestalotiopsis*. In some embodiments, the designed complex endophyte comprises an ITS nucleic acid sequence that is at least 97% identical to a sequence selected from the group consisting of SEQ ID NOs: 561, 575, 580, and 758.

In some embodiments, the designed complex endophyte comprises an endofungal fungal endophyte of one or more of the following taxa: *Acremonium, Alternaria, Aspergillus, Aureobasidium, Biscogniauxia, Botryosphaeria, Botrytis, Bullera, Cercospora, Chaetothyriales, Cladosporium, Cochliobolus, Coniothyrium, Cryptococcus, Cryptococcus* unclassified, *Davidiella, Dioszegia, Dothideales, Dothideomycetes, Epicoccum, Erysiphe, Erythrobasidium, Fusarium, Gibberella, Hannaella, Hormonema, Hypoxylon, Lecythophora, Leptospora, Lewia, Monodictys, Monographella, Mucor, Nectria, Neurospora, Paraconiothyrium, Parastagonospora, Penicillium, Periconia, Pestalotiopsis, Phaeomoniella, Phoma, Phyllosticta, Pichia, Pleosporales, Preussia, Rhizopus, Rhodosporidium, Sordariomycetes, Sporobolomyces, Sporormiaceae, Stagonospora, Udeniomyces, Wallemia, Xylaria.*

In some embodiments, the designed complex endophyte comprises an endofungal fungal endophyte chosen among those listed in Table 2, or those comprising a fungal ITS or LSU nucleic acid sequence that is at least 97% identical to at least one of the ITS or LSU nucleic acid sequences of the fungi listed in Table 2 (SEQ ID NOs: 561-758).

In some embodiments of the present invention, the endophyte is a bacterium. In some cases, bacterial genera have been reassigned due to various reasons (such as but not limited to the evolving field of whole genome sequencing), and it is understood that such nomenclature reassignments are within the scope of any claimed genus. For example, certain species of the genus *Erwinia* have been described in the literature as belonging to genus *Pantoea* (Zhang and Qiu, 2015).

In some embodiments of the present invention, the designed complex endophyte comprises bacterium of one or more of the following taxa: *Achromobacter, Acinetobacter, Actinomadura, Actinomycetospora, Actinoplanes, Adlercreutzia, Aeromicrobium, Afipia, Agrobacterium, Alcaligenes, Algoriphagus, Alicyclobacillus, Alkanindiges, Aquicella, Arenimonas, Arthrobacter, Asticcacaulis, Atopostipes, Bacillus, Bdellovibrio, Beijerinckia, Bosea, Brachybacterium, Bradyrhizobium, Brevibacillus, Brevibacterium, Brevundimonas, Burkholderia, Caldicellulosiruptor, Caloramator, Candidatus Haloredivivus, Carboxydocella, Carnobacterium, Caulobacter, Cellulosimicrobium, Cellvibrio, Chryseobacterium, Clostridium, Comamonas, Coraliomargarita, Corynebacterium, Curtobacterium,* DA101, *Deinococcus, Delftia, Devosia, Dokdonella, Dyadobacter, Dyella, Enhydrobacter, Enterobacter, Enterococcus, Erwinia, Escherichia, Escherichia/Shigella, Exiguobacterium, Ferroglobus, Filimonas, Finegoldia, Flavobacterium, Geobacillus, Halobaculum, Halomonas, Halosimplex, Herbaspirillum, Hymenobacter, Janthinobacterium, Kaistobacter, Kineococcus, Kineosporia, Kosakonia, Kribbella, Lacibacter, Lactobacillus, Lactococcus, Lentzea, Leuconostoc, Luteibacter, Lysinibacillus, Lysobacter, Massilia, Mesorhizobium, Methylibium, Methylobacterium, Microbacterium, Micrococcus, Mycobacterium, Mycoplana,*

*Mycoplasma, Nocardioides, Novosphingobium, Okibacterium, Oligotropha, Opitutus, Oryzihumus, Paenibacillus, Pantoea, Paracoccus, Pedobacter, Pelomonas, Peptoniphilus, Peredibacter, Perlucidibaca, Pigmentiphaga, Polaromonas, Polynucleobacter, Promicromonospora, Propionibacterium, Pseudoclavibacter, Pseudomonas, Quadrisphaera, Ralstonia, Rathayibacter, Rhizobium, Rhodanobacter, Rhodobacter, Rhodococcus, Rhodoplanes, Rhodopseudomonas, Saccharibacillus, Salinibacterium, Sanguibacter, Sebaldella, Sediminibacterium, Serratia, Sinosporangium, Skermanella, Solibacillus, Sphingomonas, Sphingopyxis, Staphylococcus, Stenotrophomonas, Streptococcus, Streptomyces, Stygiolobus, Sulfurisphaera, Thermoanaerobacterium, Variovorax, Weissella, Williamsia, Xanthomonas, Yonghaparkia, Zimmermannella.*

In some embodiments, the designed complex endophyte comprises an endofungal bacterial endophyte chosen among those listed in Table 1, or those comprising a 16S nucleic acid sequence that is at least 97% identical to at least one of the 16S nucleic acid sequence of the bacteria listed in Table 1 (SEQ ID NOs: 1-549).

In some embodiments, the designed complex endophyte comprises a bacterium from the genus *Streptomyces*. In some embodiments, the designed complex endophyte comprises a 16S nucleic acid sequence that is at least 97% identical to a sequence selected from the group consisting of SEQ ID NOs: 550, 551, 552, 553, 554, 555, 556, 557, 558, 559, 560, 130, 324, 394, and 532.

In some embodiments, the designed complex endophyte comprises a bacterium from the genus Luteibacter. In some embodiments, the designed complex endophyte comprises a 16S nucleic acid sequence that is at least 97% identical to a sequence selected from the group consisting of SEQ ID NOs: 9, 31, 40, 45, 46, 48, 58, 59, 60, 61, 63, 64, 65, 66, 67, 68, 175, 176, 195, 196, 397, and 549.

In some embodiments, the designed complex endophyte comprises a bacterium from the genus *Pantoea*. In some embodiments, the designed complex endophyte comprises a 16S nucleic acid sequence that is at least 97% identical to a sequence selected from the group consisting of SEQ ID NOs: 47, 55, 57, 237, 416, 459, and 548.

In some embodiments, the designed complex endophyte comprises a bacterium from the genus *Paenibacillus*. In some embodiments, the designed complex endophyte comprises a 16S nucleic acid sequence that is at least 97% identical to a sequence selected from the group consisting of SEQ ID NOs: 4, 5, 11, 12, 13, 17, 18, 19, 21, 22, 23, 24, 25, 26, 36, 37, 51, 52, 245, 248, 253, 277, 347, 462, 495, and 547.

The designed complex endophytes of the present invention may individually comprise single additional components (for example, a host fungus may comprise a single endofungal bacterial endophyte), a plurality of components of the same type (for example, a host fungus may comprise multiple endofungal bacterial endophytes of different strains), or a plurality of components of different types (for example, a host fungus may comprise multiple endofungal bacterial endophytes of different strains; in another example, a host fungus may comprise both endofungal bacterial endophytes and endofungal fungal endophytes).

In some embodiments, the designed complex endophyte is a specific combination of a fungal host and a bacterial endophyte, for example a combination comprising a composition that is at least 97% identical to a bacterial sequence of Table 1 and a composition that is at least 97% identical to a fungal sequence of Table 2.

In some embodiments, the designed complex endophyte is a specific combination of a fungal host and a plurality of different bacterial endophytes, for example a combination comprising a composition that is at least 97% identical to a fungal sequence of Table 2 and a plurality of bacteria, at least one of which is at least 97% identical to a bacterial sequence of Table 1.

In other embodiments, the designed complex endophyte is a specific combination of a single bacterial composition and a single fungal composition, selected from one of the designed complex endophytes described in Table 3.

In some cases, the designed complex endophytic component, or more than one component, is of monoclonal origin, providing high genetic uniformity of the designed complex endophyte population in an agricultural formulation or within a synthetic seed or plant combination with the endophyte.

In some embodiments, the designed complex endophyte can be cultured on a culture medium or can be adapted to culture on a culture medium.

In some embodiments, the compositions provided herein are stable. The endofungal bacterial endophyte, endofungal fungal endophyte, or designed complex endophyte may be shelf stable, where at least 10% of the CFUs are viable after storage in desiccated form (i.e., moisture content of 30% or less) for 1, 2, 3, 4, 5, 6, 7, 8, 9, 10 or greater than 10 weeks at 4° C. or at room temperature. Optionally, a shelf stable formulation is in a dry formulation, a powder formulation, or a lyophilized formulation. In some embodiments, the formulation is formulated to provide stability for the population of endofungal bacterial endophytes, endofungal fungal endophytes, or designed complex endophytes. In one embodiment, the formulation is substantially stable at temperatures between about 0° C. and about 50° C. for at least about 1, 2, 3, 4, 5, or 6 days, or 1, 2, 3 or 4 weeks, or 1, 2, 3, 4, 5, 6, 7, 8, 9, 10, 11 or 12 months, or one or more years. In another embodiment, the formulation is substantially stable at temperatures between about 4° C. and about 37° C. for at least about 5, 10, 15, 20, 25, 30 or greater than 30 days.

Functional Attributes of Designed Complex Endophytes and Designed Complex Endophyte Components In some cases, the designed complex endophyte or endophytic component may produce one or more compounds and/or have one or more activities, e.g., one or more of the following: production of a metabolite, production of a phytohormone such as auxin, production of acetoin, production of an antimicrobial compound, production of a siderophore, production of a cellulase, production of a pectinase, production of a chitinase, production of a xylanase, nitrogen fixation, or mineral phosphate solubilization. For example, a designed complex endophyte or endophytic component can produce a phytohormone selected from the group consisting of an auxin, a cytokinin, a gibberellin, ethylene, a brassinosteroid, and abscisic acid. In one particular embodiment, the designed complex endophyte or endophytic component produces auxin (e.g., indole-3-acetic acid (IAA)). Production of auxin can be assayed as described herein. Many of the microbes described herein are capable of producing the plant hormone auxin indole-3-acetic acid (IAA) when grown in culture. Auxin plays a key role in altering the physiology of the plant, including the extent of root growth. Therefore, in another embodiment, the designed complex endophytic population is disposed on the surface or within a tissue of the seed or seedling in an amount effective to detectably increase production of auxin in the agricultural plant when compared with a reference agricultural plant. In one embodiment, the increased auxin production can be detected in a tissue type selected from the group consisting of the root, shoot, leaves, and flowers.

In some embodiments, the designed complex endophyte or endophytic component can produce a compound with antimicrobial properties. For example, the compound can have antibacterial properties, as determined by the growth assays provided herein. In one embodiment, the compound with antibacterial properties shows bacteriostatic or bactericidal activity against *E. coli* and/or *Bacillus* sp. In another embodiment, the designed complex endophyte or endophytic component produces a compound with antifungal properties, for example, fungicidal or fungistatic activity against *S. cerevisiae* and/or *Rhizoctonia*.

In some embodiments, the designed complex endophyte or endophytic component comprises bacteria capable of nitrogen fixation, and is thus capable of producing ammonium from atmospheric nitrogen. The ability of bacteria to fix nitrogen can be confirmed by testing for growth of the bacteria in nitrogen-free growth media, for example, LGI media, as described in methods known in the art.

In some embodiments, the designed complex endophyte or endophytic component can produce a compound that increases the solubility of mineral phosphate in the medium, i.e., mineral phosphate solubilization, for example, using the growth assays described herein. In one embodiment, the designed complex endophyte or endophytic component n produces a compound that allows the bacterium to grow in growth media containing $Ca_3HPO_4$ as the sole phosphate source.

In some embodiments, the designed complex endophyte or endophytic component can produce a siderophore. Siderophores are small high-affinity iron chelating agents secreted by microorganisms that increase the bioavailability of iron. Siderophore production by the designed complex endophyte or endophytic component can be detected using methods known in the art.

In some embodiments, the designed complex endophyte or endophytic component can produce a hydrolytic enzyme. For example, in one embodiment, a designed complex endophyte or endophytic component can produce a hydrolytic enzyme selected from the group consisting of a cellulase, a pectinase, a chitinase and a xylanase. Hydrolytic enzymes can be detected using methods known in the art.

In some embodiments, the complex endophyte provides an improved attribute to the component fungus or bacterium. In some cases, the presence of one organism is beneficial to the other, and can be a result of any number of mechanisms of either component, or a synergistic effect of the combination of the two organisms. In some embodiments, the improved attribute is an improved ability of the endophytic bacterium to produce crystal proteins. In some embodiments, the improved attribute is an improved ability of the host fungus to sporulate.

Combinations of Designed Complex Endophytes and Designed Complex Endophyte Components Combinations of designed complex endophytes or endophytic components can be selected by any one or more of several criteria. In one embodiment, compatible designed complex endophytes or endophytic components are selected. As used herein, compatibility refers to populations of designed complex endophyte populations or endophytic components that do not significantly interfere with the growth, propagation, and/or production of beneficial substances of the other. Incompatible populations can arise, for example, where one of the populations or components produces or secrets a compound that is toxic or deleterious to the growth of the other population(s) or component(s). Incompatibility arising from production of deleterious compounds/agents can be detected using methods known in the art, and as described herein elsewhere. Similarly, the distinct populations can compete for limited resources in a way that makes co-existence difficult.

In another embodiment, combinations or components are selected on the basis of compounds produced by each population or component of designed complex endophytes or endophytic components. For example, the first population or component is capable of producing siderophores, and another population or component is capable of producing anti-fungal compounds. In one embodiment, the first population or component of designed complex endophytes or endophytic components is capable of a function selected from the group consisting of auxin production, nitrogen fixation, production of an antimicrobial compound, siderophore production, mineral phosphate solubilization, cellulase production, chitinase production, xylanase production, and acetoin production. In another embodiment, the second population of designed complex endophytes or endophytic component is capable of a function selected from the group consisting of auxin production, nitrogen fixation, production of an antimicrobial compound, siderophore production, mineral phosphate solubilization, cellulase production, chitinase production, xylanase production, and acetoin production. In still another embodiment, the first and second populations are capable of at least one different function.

In still another embodiment, the combinations of designed complex endophytes or endophytic components are selected for their distinct localization in the plant after colonization. For example, the first population of designed complex endophytes or endophytic components can colonize, and in some cases preferentially colonize, the root tissue, while a second population can be selected on the basis of its preferential colonization of the aerial parts of the agricultural plant. Therefore, in one embodiment, the first population or component is capable of colonizing one or more of the tissues selected from the group consisting of a root, shoot, leaf, flower, and seed. In another embodiment, the second population is capable of colonizing one or more tissues selected from the group consisting of root, shoot, leaf, flower, and seed. In still another embodiment, the first and second populations or components are capable of colonizing a different tissue within the agricultural plant.

In still another embodiment, combinations of designed complex endophytes or endophytic components are selected for their ability to confer one or more distinct fitness traits on the inoculated agricultural plant, either individually or in synergistic association with other endophytes. Alternatively, two or more endophytes induce the colonization of a third endophyte. For example, the first population of designed complex endophytes or endophytic components is selected on the basis that it confers significant increase in biomass, while the second population or component promotes increased drought tolerance on the inoculated agricultural plant. Therefore, in one embodiment, the first population or component is capable of conferring at least one trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. In another embodiment, the second population or component is capable of conferring a trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention. In still another embodiment, each of the first and second population or component is capable of conferring a different trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention.

The combinations of designed complex endophytes or endophytic components can also be selected based on combinations of the above criteria. For example, the first population of designed complex endophytes or endophytic components can be selected on the basis of the compound it produces (e.g., its ability to fix nitrogen, thus providing a potential nitrogen source to the plant), while the second population can be selected on the basis of its ability to confer increased resistance of the plant to a pathogen (e.g., a fungal pathogen).

In some aspects of the present invention, it is contemplated that combinations of designed complex endophytes or components can provide an increased benefit to the host plant, as compared to that conferred by a single endophyte, by virtue of additive effects. For example, one endophyte or endophytic component strain that induces a benefit in the host plant may induce such benefit equally well in a plant that is also colonized with a different endophyte or endophytic component strain that also induces the same benefit in the host plant. The host plant thus exhibits the same total benefit from the plurality of different endophyte strains as the additive benefit to individual plants colonized with each individual endophyte of the plurality. In one example, a plant is colonized with two different endophyte strains: one provides a 1× increase in seed protein content when associated with the plant, and the other provides a 2× increase in seed protein content when associated with a different plant. When both endophyte strains are associated with the same plant, that plant would experience a 3× (additive of 1×+2× single effects) increase in seed protein content. In another example, a bacterial component of a designed complex endophyte provides 1× benefit to the host plant, and the fungal component of a designed provides a 2× benefit to the host plant. When the bacterium is introduced into the fungus to create a novel designed complex endophyte, an additive effect would be if the novel designed complex endophyte provides a 3× benefit to the plant. Additive effects are a surprising aspect of the present invention, as non-compatibility of endophytes may result in a cancellation of the beneficial effects of both endophytes.

In some aspects of the present invention, it is contemplated that a combination of designed complex endophytes or components can provide an increased benefit to the host plant, as compared to that conferred by a single endophyte, by virtue of synergistic effects. For example, one endophyte strain that induces a benefit in the host plant may induce such benefit beyond additive effects in a plant that is also colonized with a different endophyte strain that also induces that benefit in the host plant. The host plant thus exhibits the greater total benefit from the plurality of different endophyte strains than would be expected from the additive benefit of individual plants colonized with each individual endophyte of the plurality. In one example, a plant is colonized with two different endophyte strains: one provides a 1× increase in seed protein content when associated with a plant, and the other provides a 2× increase in seed protein content when associated with a different plant. When both endophyte strains are associated with the same plant, that plant would experience a 5× (greater than an additive of 1×+2× single effects) increase in seed protein content. In another example, a bacterial component of a designed complex endophyte provides 1× benefit to the host plant, and the fungal component of a designed provides a 2× benefit to the host plant. When the bacterium is introduced into the fungus to create a novel designed complex endophyte, an additive effect would be if the novel designed complex endophyte provides a 5× benefit to the plant. Synergistic effects are a surprising aspect of the present invention.

Designed Complex Endophytes and Synthetic Combinations with Plants and Plant Elements It is contemplated that the methods and compositions of the present invention may be used to improve any characteristic of any agricultural plant. The methods described herein can also be used with transgenic plants comprising one or more exogenous transgenes, for example, to yield additional trait benefits conferred by the newly introduced endophytic microbes. Therefore, in one embodiment, a plant element of a transgenic maize, wheat, rice, cotton, canola, alfalfa, sorghum, soybean, barley, or other plant is contacted with a designed complex endophytes or components.

In some embodiments, the present invention contemplates the use of designed complex endophytes that can confer a beneficial agronomic trait upon the plant element or resulting plant with which it is associated.

In some cases, the designed complex endophytes or components described herein are capable of moving from one tissue type to another. For example, the present invention's detection and isolation of designed complex endophytes within the mature tissues of plants after coating on the exterior of a plant element demonstrates the designed complex endophyte's or component's ability to move from the plant element exterior into the vegetative tissues of a maturing plant. Therefore, in one embodiment, the population of designed complex endophytes or component is capable of moving from the seed exterior into the vegetative tissues of a plant. In one embodiment, the designed complex endophyte or endophytic component which is coated onto the seed of a plant is capable, upon germination of the seed into a vegetative state, of localizing to a different tissue of the plant. For example, the designed complex endophyte or endophytic component can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the designed complex endophyte or endophytic component is capable of localizing to the root and/or the root hair of the plant. In another embodiment, the designed endophyte or endophytic component is capable of localizing to the photosynthetic tissues, for example, leaves and shoots of the plant. In other cases, the designed complex endophyte or endophytic component is localized to the vascular tissues of the plant, for example, in the xylem and phloem. In still another embodiment, the designed complex endophyte or endophytic component is capable of localizing to the reproductive tissues (flower, pollen, pistil, ovaries, stamen, fruit) of the plant. In another embodiment, the designed complex endophyte or endophytic component is capable of localizing to the root, shoots, leaves and reproductive tissues of the plant. In still another embodiment, the designed complex endophyte or endophytic component colonizes a fruit or seed tissue of the plant. In still another embodiment, the designed complex endophyte or endophytic component is able to colonize the plant such that it is present in the surface of the plant (i.e., its presence is detectably present on the plant exterior, or the episphere of the plant). In still other embodiments, the designed complex endophyte or endophytic component is capable of localizing to substantially all, or all, tissues of the plant. In certain embodiments, the designed complex endophyte or endophytic component is not localized to the root of a plant. In other cases, the designed endophyte or endophytic component is not localized to the photosynthetic tissues of the plant.

In some cases, the designed complex endophytes or their components are capable of replicating within the host plant and colonizing the plant.

In some embodiments, the designed complex endophytic populations or components described herein are capable of colonizing a host plant. Successful colonization can be confirmed by detecting the presence of the fungal population within the plant. For example, after applying the designed complex endophyte to the seeds, high titers of the fungus and/or bacterium can be detected in the roots and shoots of the plants that germinate from the seeds. Detecting the presence of the designed complex endophytes or components inside the plant can be accomplished by measuring the viability of the designed complex endophyte after surface sterilization of the seed or the plant: designed complex endophytes or components colonization results in an internal localization of the designed complex endophyte or one of its components, rendering it resistant to conditions of surface sterilization. The presence and quantity of the designed complex endophyte can also be established using other means known in the art, for example, immunofluorescence microscopy using microbe-specific antibodies, or fluorescence in situ hybridization (see, for example, Amann et al. (2001) Current Opinion in Biotechnology 12:231-236, incorporated herein by reference in its entirety). Alternatively, specific nucleic acid probes recognizing conserved sequences from an designed endophyte fungus or bacterium can be employed to amplify a region, for example by quantitative PCR, and correlated to CFUs (Colony Forming Units) by means of a standard curve.

In some cases, plants are inoculated with designed complex endophytes whose components are isolated from the same species of plant as the plant element of the inoculated plant. For example, an endophytic component that is normally found in one variety of Zea mays (corn) is associated with a plant element of a plant of another variety of Zea mays that in its natural state lacks said endophytic component. In one embodiment, an endophytic component is derived from a plant of a related species of plant as the plant element of the inoculated plant. For example, an endophytic component that is normally found in Zea diploperennis, (diploperennial teosinte) is applied to a Zea mays (corn), or vice versa. In some cases, plants are inoculated with endophytic components that are heterologous to the plant element of the inoculated plant. In one embodiment, t an endophytic component is derived from a plant of another species. For example, an endophytic component that is normally found in dicots is applied to a monocot plant (e.g., inoculating corn with a soy bean-derived endophyte), or vice versa. In other cases, an endophytic component to be inoculated onto a plant is derived from a related species of the plant that is being inoculated. In one embodiment, an endophytic component is derived from a related taxon, for example, from a related species. The plant of another species can be an agricultural plant.

In another embodiment, the designed complex endophyte is disposed, for example, on the surface of a reproductive element of an agricultural plant, in an amount effective to be detectable in the mature agricultural plant. In one embodiment, the endophyte is disposed in an amount effective to be detectable in an amount of at least about 100 CFU, between 100 and 200 CFU, at least about 200 CFU, between 200 and 300 CFU, at least about 300 CFU, between 300 and 400 CFU, at least about 500 CFU, between 500 and 1,000 CFU, at least about 1,000 CFU, between 1,000 and 3,000 CFU, at least about 3,000 CFU, between 3,000 and 10,000 CFU, at least about 10,000 CFU, between 10,000 and 30,000 CFU, at least about 30,000 CFU, between 30,000 and 100,000 CFU, at least about 100,000 CFU or more in the mature agricultural plant.

In some cases, the designed complex endophyte or endophytic component is capable of colonizing particular plant elements or tissue types of the plant. In one embodiment, the designed complex endophyte or endophytic component is disposed on the seed or seedling in an amount effective to be detectable within a target tissue of the mature agricultural plant selected from a fruit, a seed, a leaf, or a root, or portion thereof. For example, the designed complex endophyte or endophytic component can be detected in an amount of at least about 100 CFU, between 100 and 200 CFU, at least about 200 CFU, between 200 and 300 CFU, at least about 300 CFU, between 300 and 500 CFU, at least about 500 CFU, between 500 and 1,000 CFU, at least about 1,000 CFU, between 1,000 and 3,000 CFU, at least about 3,000 CFU, between 3,000 and 10,000 CFU, at least about 10,000 CFU, between 10,000 CFU and 30,000 CFU, at least about 30,000 CFU, between about 30,000 and 100,000 CFU, at least about 100,000 CFU, or more than 100,000 CFU, in the target tissue of the mature agricultural plant.

Endophytes Compatible with Agrichemicals

In certain embodiments, the designed complex endophyte or endophytic component is selected on the basis of its compatibility with commonly used agrichemicals. As mentioned earlier, plants, particularly agricultural plants, can be treated with a vast array of agrichemicals, including fungicides, biocides (anti-complex agents), herbicides, insecticides, nematicides, rodenticides, fertilizers, and other agents.

In some cases, it can be important for the designed complex endophyte or endophytic component to be compatible with agrichemicals, particularly those with fungicidal or anticomplex properties, in order to persist in the plant although, as mentioned earlier, there are many such fungicidal or anticomplex agents that do not penetrate the plant, at least at a concentration sufficient to interfere with the designed complex endophyte. Therefore, where a systemic fungicide or anticomplex agent is used in the plant, compatibility of the designed complex endophyte or endophytic component to be inoculated with such agents will be an important criterion.

In one embodiment, natural isolates of a designed complex endophyte or endophytic component that are compatible with agrichemicals can be used to inoculate the plants according to the methods described herein. For example, designed complex endophytes or components that are compatible with agriculturally employed fungicides can be isolated by plating a culture of the designed complex endophytes on a petri dish containing an effective concentration of the fungicide, and isolating colonies of the designed complex endophyte that are compatible with the fungicide. In another embodiment, a designed complex endophyte or endophytic component that is compatible with a fungicide is used for the methods described herein.

Fungicide- and bactericide-compatible designed complex endophytes or components can also be isolated by selection on liquid medium. The culture of designed complex endophytes can be plated on petri dishes without any forms of mutagenesis; alternatively, the designed complex endophytes can be mutagenized using any means known in the art. For example, designed complex endophyte or endophytic component cultures can be exposed to UV light, gamma-irradiation, or chemical mutagens such as ethylmethanesulfonate (EMS) prior to selection on fungicide containing media. Finally, where the mechanism of action of a particular fungicide or bactericide is known, the target gene can be specifically mutated (either by gene deletion, gene replacement, site-directed mutagenesis, etc.) to generate a designed complex endophyte that is resilient against that particular chemical. It is noted that the above-described methods can be used to isolate designed complex endophytes that are compatible with both fungistatic and fungicidal compounds, as well as bacteriostatic and bactericidal compounds.

It will also be appreciated by one skilled in the art that a plant may be exposed to multiple types of fungicides or anticomplex compounds, either simultaneously or in succession, for example at different stages of plant growth. Where the target plant is likely to be exposed to multiple fungicidal and/or anticomplex agents, a designed complex endophyte or endophytic component that is compatible with many or all of these agrichemicals can be used to inoculate the plant. A designed complex endophyte or endophytic component that is compatible with several fungicidal agents can be isolated, for example, by serial selection. A designed complex endophyte or endophytic component that is compatible with the first fungicidal agent can be isolated as described above (with or without prior mutagenesis). A culture of the resulting designed complex endophyte or endophytic component can then be selected for the ability to grow on liquid or solid media containing the second antifungal compound (again, with or without prior mutagenesis). Colonies isolated from the second selection are then tested to confirm its compatibility to both antifungal compounds.

Likewise, designed complex endophytes or components that are compatible to biocides (including herbicides such as glyphosate or anticomplex compounds, whether bacteriostatic or bactericidal) that are agriculturally employed can be isolated using methods similar to those described for isolating fungicide compatible designed complex endophytes or components. In one embodiment, mutagenesis of the designed complex endophyte or endophytic component populations can be performed prior to selection with an anticomplex agent. In another embodiment, selection is performed on the designed complex endophyte or endophytic component population without prior mutagenesis. In still another embodiment, serial selection is performed on a designed complex endophyte or endophytic component: the designed complex endophyte or endophytic component is first selected for compatibility to a first anticomplex agent. The isolated compatible designed complex endophyte or endophytic component is then cultured and selected for compatibility to the second anticomplex agent. Any colony thus isolated is tested for compatibility to each, or both anticomplex agents to confirm compatibility with these two agents.

Compatibility with an antimicrobial agent can be determined by a number of means known in the art, including the comparison of the minimal inhibitory concentration (MIC) of the unmodified and modified endophytes. Therefore, in one embodiment, the present invention discloses an isolated designed complex endophyte or endophytic component, wherein the endophyte is modified such that it exhibits at least 3 fold greater, for example, at least 5 fold greater, between 5 and 10 fold greater, at least 10 fold greater, between 10 and 20 fold greater, at least 20 fold greater, between 20 and 30 fold greater, at least 30 fold greater or more MIC to an antimicrobial agent when compared with the unmodified endophyte.

In a particular embodiment, disclosed herein are designed complex endophytes and components with enhanced compatibility to the herbicide glyphosate. In one embodiment, the designed complex endophyte or endophytic component has a doubling time in growth medium comprising at least 1 mM glyphosate, for example, between 1 mM and 2 mM glyphosate, at least 2 mM glyphosate, between 2 mM and 5 mM glyphosate, at least 5 mM glyphosate, between 5 mM and 10 mM glyphosate, at least 10 mM glyphosate, between 10 mM and 15 mM glyphosate, at least 15 mM glyphosate or more, that is no more than 250%, between 250% and 100%, for example, no more than 200%, between 200% and 175%, no more than 175%, between 175% and 150%, no more than 150%, between 150% and 125%, or no more than 125%, of the doubling time of the endophyte in the same growth medium comprising no glyphosate. In one particular embodiment, the designed complex endophyte or endophytic component has a doubling time in growth medium comprising 5 mM glyphosate that is no more than 150% the doubling time of the designed complex endophyte or endophytic component in the same growth medium comprising no glyphosate.

In another embodiment, the designed complex endophyte or endophytic component has a doubling time in a plant tissue comprising at least 10 ppm glyphosate, 10 and 15 ppm, for example, at least 15 ppm glyphosate, between 15 and 10 ppm, at least 20 ppm glyphosate, between 20 and 30 ppm, at least 30 ppm glyphosate, between 30 and 40 ppm, at least 40 ppm glyphosate or more, that is no more than 250%, between 250% and 200%, for example, no more than 200%, between 200% and 175%, no more than 175%, between 175% and 150%, no more than 150%, between 150% and 125%, or no more than 125%, of the doubling time of the endophyte in a reference plant tissue comprising no glyphosate. In one particular embodiment, the designed complex endophyte or endophytic component has a doubling time in a plant tissue comprising 40 ppm glyphosate that is no more than 150% the doubling time of the designed complex endophyte or endophytic component in a reference plant tissue comprising no glyphosate.

The selection process described above can be repeated to identify isolates of the designed complex endophyte or endophytic component that are compatible with a multitude of antifungal or anticomplex agents.

Candidate isolates can be tested to ensure that the selection for agrichemical compatibility did not result in loss of a desired bioactivity. Isolates of the designed complex endophyte or endophytic component that are compatible with commonly employed fungicides can be selected as described above. The resulting compatible designed complex endophyte or endophytic component can be compared with the parental designed complex endophyte or endophytic component on plants in its ability to promote germination.

The agrichemical compatible designed complex endophyte or endophytic component generated as described above can be detected in samples. For example, where a transgene was introduced to render the designed complex endophyte or endophytic component compatible with the agrichemical(s), the transgene can be used as a target gene for amplification and detection by PCR. In addition, where point mutations or deletions to a portion of a specific gene or a number of genes results in compatibility with the agrichemical(s), the unique point mutations can likewise be detected by PCR or other means known in the art. Such methods allow the detection of the designed complex endophyte or endophytic component even if it is no longer viable. Thus, commodity plant products produced using the agrichemical compatible designed complex endophyte or endophytic component described herein can readily be identified by employing these and related methods of nucleic acid detection.

Beneficial Attributes of Synthetic Combinations of Plant Elements and Designed Complex Endophytes
Improved Attributes Conferred by the Designed Complex Endophyte or Endophytic Component The present invention contemplates the establishment of a symbiont in a plant element. In one embodiment, the designed complex endophyte or endophytic component association results in a detectable change to the plant element, in particular the seed or the whole plant. The detectable change can be an improvement in a number of agronomic traits (e.g., improved general health, increased response to biotic or abiotic stresses, or enhanced properties of the plant or a plant part, including fruits and grains). Alternatively, the detectable change can be a physiological or biological change that can be measured by methods known in the art. The detectable changes are described in more detail in the sections below. As used herein, a designed complex endophyte or endophytic component is considered to have conferred an improved agricultural trait whether or not the improved trait arose from the plant, the designed complex endophyte, or component, or the concerted action between any or all of the preceeding. Therefore, for example, whether a beneficial hormone or chemical is produced by the plant or designed complex endophyte or endophytic component, for purposes of the present invention, the designed complex endophyte will be considered to have conferred an improved agronomic trait upon the host plant.

In some embodiments, plant-endophyte (designed or component) combinations confer an agronomic benefit in agricultural plants. In some embodiments, the agronomic trait is selected from the group consisting of altered oil content, altered protein content, altered seed carbohydrate composition, altered seed oil composition, and altered seed protein composition, chemical tolerance, cold tolerance, delayed senescence, disease resistance, drought tolerance, increased ear weight, growth improvement, health enhancement, heat tolerance, herbicide tolerance, herbivore resistance, improved nitrogen fixation, improved nitrogen utilization, improved nutrient use efficiency, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased seed germination, increased number of pods per plant, increased length of pods per plant, reduced number of wilted leaves per plant, reduced number of severely wilted leaves per plant, increased number of non-wilted leaves per plant, increased plant height, earlier or increased flowering, increased protein content, increased fermentable carbohydrate content, reduced lignin content, male sterility, increased antioxidant content, modulation in the level of a metabolite, a detectable modulation in the level of a transcript, and a detectable modulation in the proteome relative to a reference plant. In other embodiments, at least two agronomic traits are improved in the agricultural plant.

For example, the designed complex endophyte or endophytic component may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, or at least 300% or more, when compared with uninoculated plants grown under the same conditions.

In some aspects, provided herein, are methods for producing a seed of a plant with a heritably altered trait. The trait of the plant can be altered without known genetic modification of the plant genome, and comprises the following steps. First, a preparation of a designed complex endophyte or endophytic component that is heterologous to the seed of the plant is provided, and optionally processed to produce a designed complex endophyte formulation. The designed complex endophyte formulation is then contacted with the plant or a plant element. The plants are then allowed to mature, and the seeds or other plant elements are collected.

Improved General Health

Also described herein are plants, and fields of plants, that are associated with beneficial designed complex endophytes or components, such that the overall fitness, productivity or health of the plant or a portion thereof, is maintained, increased and/or improved over a period of time. Improvement in overall plant health can be assessed using numerous physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof. Improved plant health, or improved field health, can also be demonstrated through improved resistance or response to a given stress, either biotic or abiotic stress, or a combination of one or more abiotic stresses, as provided herein.

Other Abiotic Stresses

Disclosed herein are designed complex endophyte-associated plants with increased resistance to an abiotic stress. Exemplary abiotic stresses include, but are not limited to:

Drought and Heat Tolerance.

When soil water is depleted or if water is not available during periods of drought, crop yields are restricted. Plant water deficit develops if transpiration from leaves exceeds the supply of water from the roots. The available water supply is related to the amount of water held in the soil and the ability of the plant to reach that water with its root system. Transpiration of water from leaves is linked to the fixation of carbon dioxide by photosynthesis through the stomata. The two processes are positively correlated so that high carbon dioxide influx through photosynthesis is closely linked to water loss by transpiration. As water transpires from the leaf, leaf water potential is reduced and the stomata tend to close in a hydraulic process limiting the amount of photosynthesis. Since crop yield is dependent on the fixation of carbon dioxide in photosynthesis, water uptake and transpiration are contributing factors to crop yield. Plants which are able to use less water to fix the same amount of carbon dioxide or which are able to function normally at a lower water potential have the potential to conduct more photosynthesis and thereby to produce more biomass and economic yield in many agricultural systems.

In some cases, a plant resulting from seeds or other plant components treated with the designed complex endophyte or endophytic component can exhibit a physiological change, such as a compensation of the stress-induced reduction in photosynthetic activity (expressed, for example, as $\Delta Fv/Fm$) after exposure to heat shock or drought conditions as compared to a corresponding control, genetically identical plant that does not contain the endophytes grown in the same conditions. In some cases, the designed complex endophyte- or endophytic component-associated plant as disclosed herein can exhibit an increased change in photosynthetic activity $\Delta Fv(\Delta Fv/Fm)$ after heat-shock or drought stress treatment, for example 1, 2, 3, 4, 5, 6, 7 days or more after the heat-shock or drought stress treatment, or until photosynthesis ceases, as compared with corresponding control plant of similar developmental stage but not containing the designed complex endophyte. For example, a plant having a designed complex endophyte able to confer heat and/or drought-tolerance can exhibit a $\Delta Fv/Fm$ of from about 0.1 to about 0.8 after exposure to heat-shock or drought stress or a $\Delta Fv/Fm$ range of from about 0.03 to about 0.8 under one day, or 1, 2, 3, 4, 5, 6, 7, or over 7 days post heat-shock or drought stress treatment, or until photosynthesis ceases. In some embodiments, stress-induced reductions in photosynthetic activity can be compensated by at least about 0.25% (for example, at least about 0.5%, between 0.5% and 1%, at least about 1%, between 1% and 2%, at least about 2%, between 2% and 3%, at least about 3%, between 3% and 5%, at least about 5%, between 5% and 10%, at least about 8%, at least about 10%, between 10% and 15%, at least about 15%, between 15% and 20%, at least about 20%, between 20$ and 25%, at least about 25%, between 25% and 30%, at least about 30%, between 30% and 40%, at least about 40%, between 40% and 50%, at least about 50%, between 50% and 60%, at least about 60%, between 60% and 75%, at least about 75%, between 75% and 80%, at least about 80%, between 80% and 85%, at least about 85%, between 85% and 90%, at least about 90%, between 90% and 95%, at least about 95%, between 95% and 99%, at least about 99% between 99% and 100%, or at least 100%) as compared to the photosynthetic activity decrease in a corresponding reference agricultural plant following heat shock conditions. Significance of the difference between endophyte-associated and reference agricultural plants can be established upon demonstrating statistical significance, for example at $p<0.05$ with an appropriate parametric or non-parametric statistic, e.g., Chi-square test, Student's t-test, Mann-Whitney test, or F-test based on the assumption or known facts that the endophyte-associated plant and reference agricultural plant have identical or near identical genomes (isoline comparison).

In selecting traits for improving crops, a decrease in water use, without a change in growth would have particular merit in an irrigated agricultural system where the water input costs were high. An increase in growth without a corresponding jump in water use would have applicability to all agricultural systems. In many agricultural systems where water supply is not limiting, an increase in growth, even if it came at the expense of an increase in water use also increases yield. Water use efficiency (WUE) is a parameter often correlated with drought tolerance, and is the CO2 assimilation rate per water transpired by the plant. An increased water use efficiency of the plant relates in some cases to an increased fruit/kernel size or number. Therefore, in some embodiments, the plants described herein exhibit an increased water use efficiency when compared with a reference agricultural plant grown under the same conditions. For example, the plants grown from the plant elements comprising the designed complex endophytes or endophytic components can have at least 3%, between 3% and 5%, at least 5%, between 5% and 10%, at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100% higher WUE than a reference agricultural plant grown under the same conditions. Such an increase in WUE can occur under conditions without water deficit, or under conditions of water deficit, for example, when the soil water content is less than or equal to 60% of water saturated soil, for example, less than or equal to 50%, less than or equal to 40%, less than or equal to 30%, less than or equal to 20%, less than or equal to 10% of water saturated soil on a weight basis. In a related embodiment, the plant comprising the designed complex endophytes or endophytic component can have at least 10% higher relative water content (RWC), for example, at least 3%, between 3% and 5%, at least 5%, between 5% and 10%, at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100% higher RWC than a reference agricultural plant grown under the same conditions.

In some embodiments, the plants comprise designed complex endophyte able to increase heat and/or drought-tolerance in sufficient quantity, such that increased growth or improved recovery from wilting under conditions of heat or drought stress is observed. For example, a designed complex endophyte population described herein can be present in sufficient quantity in a plant, resulting in increased growth as compared to a plant that does not contain the endofungal bacterial endophyte, when grown under drought conditions or heat shock conditions, or following such conditions. Increased heat and/or drought tolerance can be assessed with physiological parameters including, but not limited to, increased height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, wilt recovery, turgor pressure, or any combination thereof, as compared to a reference agricultural plant grown under similar conditions. For example, the designed complex endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Salt Stress.

In other embodiments, a designed complex endophyte or endophytic component able to confer increased tolerance to salinity stress can be introduced into plants. The resulting plants comprising designed complex endophytes can exhibit increased resistance to salt stress, whether measured in terms of survival under saline conditions, or overall growth during, or following salt stress. The physiological parameters of plant health recited above, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., isogenic plants without the endophytes) grown under identical conditions. For example, the designed complex endophyte may provide an improved benefit or tolerance to a plant that is of at least 3%, between 3% and 5%, at least 5%, between 5% and 10%, at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions. In other instances, endophyte-associated plants and reference agricultural plants can be grown in soil or growth media comprising different concentration of sodium to establish the inhibitory concentration of 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions. In other instances, designed complex endophyte-associated plants and reference agricultural plants can be grown in soil or growth media comprising different concentration of sodium to establish the inhibitory concentration of sodium (expressed, for example, as the concentration in which growth of the plant is inhibited by 50% when compared with plants grown under no sodium stress). Therefore, in another embodiment, a plant resulting from plant elements comprising a designed complex endophyte or endophytic component able to confer salt tolerance described herein exhibits an increase in the inhibitory sodium concentration by at least 10 mM, between 10 mM and 15 mM, for example at least 15 mM, between 15 mM and 20 mM, at least 20 mM, between 20 mM and 30 mM, at least 30 mM, between 30 mM and 40 mM, at least 40 mM, between 40 mM and 50 mM, at least 50 mM, between 50 mM and 60 mM, at least 60 mM, between 60 mM and 70 mM, at least 70 mM, between 70 mM and 80 mM, at least 80 mM, between 80 mM and 90 mM, at least 90 mM, between 90 mM and 100 mM, at least 100 mM or more, when compared with the reference agricultural plants.

High Metal Content.

Plants are sessile organisms and therefore must contend with the environment in which they are placed. Plants have adapted many mechanisms to deal with chemicals and substances that may be deleterious to their health. Heavy metals in particular represent a class of toxins that are highly relevant for plant growth and agriculture, because many of them are associated with fertilizers and sewage sludge used to amend soils and can accumulate to toxic levels in agricultural fields. Therefore, for agricultural purposes, it is important to have plants that are able to tolerate soils comprising elevated levels of toxic heavy metals. Plants cope with toxic levels of heavy metals (for example, nickel, cadmium, lead, mercury, arsenic, or aluminum) in the soil by excretion and internal sequestration. Endophytes that are able to confer increased heavy metal tolerance may do so by enhancing sequestration of the metal in certain compartments away from the seed or fruit and/or by supplementing other nutrients necessary to remediate the stress. Use of such endophytes, for example as a designed complex endophyte or endophytic component thereof, in a plant would allow the development of novel plant-endophyte combinations for purposes of environmental remediation (also known as phytoremediation). Therefore, in one embodiment, the plant comprising a designed complex endophyte shows increased metal tolerance as compared to a reference agricultural plant grown under the same heavy metal concentration in the soil.

Alternatively, the inhibitory concentration of the heavy metal can be determined for a designed complex endophyte- or component-associated plant and compared with a reference agricultural plant under the same conditions. Therefore, in one embodiment, the plants resulting from plant elements comprising a designed complex endophyte able to confer heavy metal tolerance described herein exhibit an increase in the inhibitory metal concentration by at least 0.1 mM, between 0.1 mM and 0.3 mM, for example at least 0.3 mM, between 0.3 mM and 0.5 mM, at least 0.5 mM, between 0.5 mM and 1 mM, at least 1 mM, between 1 mM and 2 mM, at least 2 mM, between 2 mM and 5 mM, at least 5 mM, between 5 mM and 10 mM, at least 10 mM, between 10 mM and 15 mM, at least 15 mM, between 15 mM and 20 mM, at least 20 mM, between 20 mM and 30 mM, at least 30 mM, between 30 mM and 50 mM, at least 50 mM or more, when compared with the reference agricultural plants.

Finally, plants inoculated with a designed complex endophyte or endophytic component that are able to confer increased metal tolerance exhibit an increase in overall metal excretion by at least 3%, between 3% and 5%, at least 5%, between 5% and 10%, at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Low Nutrient Stress.

Designed complex endophytes or components described herein may also confer to the plant an increased ability to grow in nutrient limiting conditions, for example by solubilizing or otherwise making available to the plants macronutrients or micronutrients that are complexed, insoluble, or otherwise in an unavailable form. In one embodiment, a plant is inoculated with an endophyte that confers increased ability to liberate and/or otherwise provide to the plant with nutrients selected from the group consisting of phosphate, nitrogen, potassium, iron, manganese, calcium, molybdenum, vitamins, or other micronutrients. Such a plant can exhibit increased growth in soil comprising limiting amounts of such nutrients when compared with reference agricultural plant. Differences between the designed complex endophyte-associated plant and reference agricultural plant can be measured by comparing the biomass of the two plant types grown under limiting conditions, or by measuring the physical parameters described above. Therefore, in one embodiment, the plant comprising a designed complex endophyte shows increased tolerance to nutrient limiting conditions as compared to a reference agricultural plant grown under the same nutrient limited concentration in the soil, as measured for example by increased biomass or seed yield of at least 3%, between 3% and 5%, at least 5%, between 5% and 10%, at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

In other embodiments, the plant comprising the designed complex endophyte or endophytic component is able to grown under nutrient stress conditions while exhibiting no difference in the physiological parameter compared to a plant that is grown without nutrient stress. In some embodiments, such a plant will exhibit no difference in the physiological parameter when grown with 2-5% less nitrogen than average cultivation practices on normal agricultural land, for example, at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, or between 75% and 100%, less nitrogen, when compared with crop plants grown under normal conditions during an average growing season. In some embodiments, the microbe capable of providing nitrogen-stress tolerance to a plant is diazotrophic. In other embodiments, the microbe capable of providing nitrogen-stress tolerance to a plant is non-diazotrophic.

Cold Stress.

In some cases, designed complex endophytes can confer to the plant the ability to tolerate cold stress. Many known methods exist for the measurement of a plant's tolerance to cold stress. As used herein, cold stress refers to both the stress induced by chilling (0° C.-15° C.) and freezing (<0° C.). Some cultivars of agricultural plants can be particularly sensitive to cold stress, but cold tolerance traits may be multigenic, making the breeding process difficult. Endophytes able to confer cold tolerance can reduce the damage suffered by farmers on an annual basis. Improved response to cold stress can be measured by survival of plants, production of protectant substances such as anthocyanin, the amount of necrosis of parts of the plant, or a change in crop yield loss, as well as the physiological parameters used in other examples. Therefore, in an embodiment, the plant comprising a designed complex endophyte or endophytic component shows increased cold tolerance exhibits as compared to a reference agricultural plant grown under the same conditions of cold stress. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Biotic Stress.

In other embodiments, the designed complex endophyte protects the plant from a biotic stress, for example, insect infestation, nematode infestation, complex infection, fungal infection, bacterial infection, oomycete infection, protozoal infection, viral infection, and herbivore grazing, or a combination thereof. For example, the designed complex endophyte or endophytic component may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Insect Herbivory.

There are an abundance of insect pest species that can infect or infest a wide variety of plants. Pest infestation can lead to significant damage. Insect pests that infest plant species are particularly problematic in agriculture as they can cause serious damage to crops and significantly reduce plant yields. A wide variety of different types of plant are susceptible to pest infestation including commercial crops such as cotton, soybean, wheat, barley, and corn.

In some cases, designed complex endophytes or components described herein may confer upon the host plant the ability to repel insect herbivores. In other cases, the designed complex endophyte or endophytic component may produce, or induce the production in the plant of, compounds which are insecticidal or insect repellant. The insect may be any one of the common pathogenic insects affecting plants, particularly agricultural plants.

The designed complex endophyte-associated plant can be tested for its ability to resist, kill, or otherwise repel, pathogenic insects by measuring, for example, insect load, overall plant biomass, biomass of the fruit or grain, percentage of intact leaves, or other physiological parameters described herein, and comparing with a reference agricultural plant. In an embodiment, the designed complex endophyte-associated plant exhibits increased biomass as compared to a reference agricultural plant grown under the same conditions (e.g., grown side-by-side, or adjacent to, endophyte-associated plants). In other embodiments, the designed complex endophyte-associated plant exhibits increased fruit or grain yield as compared to a reference agricultural plant grown under the same conditions (e.g., grown side-by-side, or adjacent to, endophyte-associated plants).

In any of the above, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Nematodes.

Nematodes are microscopic roundworms that feed on the roots, fluids, leaves and stems of more than 2,000 row crops, vegetables, fruits, and ornamental plants, causing an estimated $100 billion crop loss worldwide and accounting for 13% of global crop losses due to disease. A variety of parasitic nematode species infect crop plants, including root-knot nematodes (RKN), cyst- and lesion-forming nematodes. Root-knot nematodes, which are characterized by causing root gall formation at feeding sites, have a relatively broad host range and are therefore parasitic on a large number of crop species. The cyst- and lesion-forming nematode species have a more limited host range, but still cause considerable losses in susceptible crops.

Signs of nematode damage include stunting and yellowing of leaves, and wilting of the plants during hot periods. Nematode infestation, however, can cause significant yield losses without any obvious above-ground disease symptoms. The primary causes of yield reduction are due to underground root damage. Roots infected by SCN are dwarfed or stunted. Nematode infestation also can decrease the number of nitrogen-fixing nodules on the roots, and may make the roots more susceptible to attacks by other soil-borne plant nematodes.

In an embodiment, the designed complex endophyte- or component-associated plant has an increased resistance to a nematode when compared with a reference agricultural plant. As before with insect herbivores, biomass of the plant or a portion of the plant, or any of the other physiological parameters mentioned elsewhere, can be compared with the reference agricultural plant grown under the same conditions. Examples of useful measurements include overall plant biomass, biomass and/or size of the fruit or grain, and root biomass. In one embodiment, the designed complex endophyte-associated plant exhibits increased biomass as compared to a reference agricultural plant grown under the same conditions (e.g., grown side-by-side, or adjacent to, the designed complex endophyte-associated plants, under conditions of nematode challenge). In another embodiment, the designed complex endophyte-associated plant exhibits increased root biomass as compared to a reference agricultural plant grown under the same conditions (e.g., grown side-by-side, or adjacent to, the designed complex endophyte-associated plants, under conditions of nematode challenge). In still another embodiment, the designed complex endophyte-associated plant exhibits increased fruit or grain yield as compared to a reference agricultural plant grown under the same conditions (e.g., grown side-by-side, or adjacent to, the endophyte-associated plants, under conditions of nematode challenge).

In any of the above, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Fungal Pathogens.

Fungal diseases are responsible for yearly losses of over $10 Billion on agricultural crops in the US, represent 42% of global crop losses due to disease, and are caused by a large variety of biologically diverse pathogens. Different strategies have traditionally been used to control them. Resistance traits have been bred into agriculturally important varieties, thus providing various levels of resistance against either a narrow range of pathogen isolates or races, or against a broader range. However, this involves the long and labor intensive process of introducing desirable traits into commercial lines by genetic crosses and, due to the risk of pests evolving to overcome natural plant resistance, a constant effort to breed new resistance traits into commercial lines is required. Alternatively, fungal diseases have been controlled by the application of chemical fungicides. This strategy usually results in efficient control, but is also associated with the possible development of resistant pathogens and can be associated with a negative impact on the environment. Moreover, in certain crops, such as barley and wheat, the control of fungal pathogens by chemical fungicides is difficult or impractical.

The present invention contemplates the use of designed complex endophytes or components that are able to confer resistance to fungal pathogens to the host plant. Increased resistance to fungal inoculation can be measured, for example, using any of the physiological parameters presented above, by comparing with reference agricultural plants. In an embodiment, the designed complex endophyte-associated plant exhibits increased biomass and/or less pronounced disease symptoms as compared to a reference agricultural plant grown under the same conditions (e.g., grown side-by-side, or adjacent to, the designed complex endophyte-associated plants, infected with the fungal pathogen). In still another embodiment, the designed complex endophyte-associated plant exhibits increased fruit or grain yield as compared to a reference agricultural plant grown under the same conditions (e.g., grown side-by-side, or adjacent to, the designed complex endophyte-associated plants, infected with the fungal pathogen). In another embodiment, the designed complex endophyte-associated plant exhibits decreased hyphal growth as compared to a reference agricultural plant grown under the same conditions (e.g., grown side-by-side, or adjacent to, the designed complex endophyte-associated plants, infected with the fungal pathogen). For example, the designed complex endophyte may provide an improved benefit to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Viral Pathogens.

Plant viruses are estimated to account for 18% of global crop losses due to disease. There are numerous examples of viral pathogens affecting agricultural productivity. In an embodiment, the designed complex endophyte or endophytic component provides protection against viral pathogens such that the plant has increased biomass as compared to a reference agricultural plant grown under the same conditions. In still another embodiment, the designed complex endophyte-associated plant exhibits the same or greater fruit or grain yield, when challenged with a virus, as compared to a reference agricultural plant grown under the same conditions. In yet another embodiment, the designed complex endophyte-associated plant exhibits lower viral titer, when challenged with a virus, as compared to a reference agricultural plant grown under the same conditions.

Complex Pathogens.

Likewise, bacterial pathogens are a significant problem negatively affecting agricultural productivity and accounting for 27% of global crop losses due to plant disease. In an embodiment, the designed complex endophyte or endophytic component described herein provides protection against bacterial pathogens such that the plant has greater biomass as compared to a reference agricultural plant grown under the same conditions. In still another embodiment, the designed complex endophyte-associated plant exhibits greater fruit or grain yield, when challenged with a complex pathogen, as compared to a reference agricultural plant grown under the same conditions. In yet another embodiment, the designed complex endophyte-associated plant exhibits lower complex count, when challenged with a bacterium, as compared to a reference agricultural plant grown under the same conditions.

Yield and Biomass Improvement.

In other embodiments, the improved trait can be an increase in overall biomass of the plant or a part of the plant, including its fruit or seed. In some embodiments, a designed complex endophyte or endophytic component is disposed on the surface or within a tissue of the plant element in an amount effective to increase the biomass of the plant, or a part or tissue of the plant grown from the plant element. The increased biomass is useful in the production of commodity products derived from the plant. Such commodity products include an animal feed, a fish fodder, a cereal product, a processed human-food product, a sugar or an alcohol. Such products may be a fermentation product or a fermentable product, one such exemplary product is a biofuel. The increase in biomass can occur in a part of the plant (e.g., the root tissue, shoots, leaves, etc.), or can be an increase in overall biomass. Increased biomass production, such an increase meaning at at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions. Such increase in overall biomass can be under relatively stress-free conditions. In other cases, the increase in biomass can be in plants grown under any number of abiotic or biotic stresses, including drought stress, salt stress, heat stress, cold stress, low nutrient stress, nematode stress, insect herbivory stress, fungal pathogen stress, bacterial pathogen stress, and viral pathogen stress. In some embodiments, a designed complex endophyte or endophytic component is disposed in an amount effective to increase root biomass by at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions, when compared with a reference agricultural plant.

In other cases, a designed complex endophyte or endophytic component is disposed on the plant element in an amount effective to increase the average biomass of the fruit or cob from the resulting plant at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Increase in Plant Growth Hormones.

Many of the microbes described herein are capable of producing the plant hormone auxin indole-3-acetic acid (IAA) when grown in culture. Auxin may play a key role in altering the physiology of the plant, including the extent of root growth. Therefore, in other embodiments, a designed complex endophyte or endophytic component is disposed on the surface or within a tissue of the plant element in an amount effective to detectably induce production of auxin in the agricultural plant. For example, the increase in auxin production can be at least 2%, at least 3%, at least 4%, at least 5%, at least 6%, at least 7%, at least 8%, at least 9%, at least 10%, at least 15%, for example, at least 20%, at least 30%, at least 40%, at least 50%, at least 60%, at least 75%, at least 100%, or more, when compared with a reference agricultural plant. In some embodiments, the increased auxin production can be detected in a tissue type selected from the group consisting of the root, shoot, leaves, and flowers.

Improvement of Other Traits

In other embodiments, the inoculated designed complex endophyte or endophytic component can confer other beneficial traits to the plant. Improved traits can include an improved nutritional content of the plant or plant part used for human consumption. In one embodiment, the designed complex endophyte- or endophytic component-associated plant is able to produce a detectable change in the content of at least one nutrient. Examples of such nutrients include amino acid, protein, oil (including any one of Oleic acid, Linoleic acid, Alpha-linoleic acid, Saturated fatty acids, Palmitic acid, Stearic acid and Trans fats), carbohydrate (including sugars such as sucrose, glucose and fructose, starch, or dietary fiber), Vitamin A, Thiamine (vit. B1), Riboflavin (vit. B2), Niacin (vit. B3), Pantothenic acid (B5), Vitamin B6, Folate (vit. B9), Choline, Vitamin C, Vitamin E, Vitamin K, Calcium, Iron, Magnesium, Manganese, Phosphorus, Potassium, Sodium, Zinc. In one embodiment, the endophyte-associated plant or part thereof contains at least one increased nutrient when compared with reference agricultural plants.

In other cases, the improved trait can include reduced content of a harmful or undesirable substance when compared with reference agricultural plants. Such compounds include those which are harmful when ingested in large quantities or are bitter tasting (for example, oxalic acid, amygdalin, certain alkaloids such as solanine, caffeine, nicotine, quinine and morphine, tannins, cyanide). As such, in one embodiment, the designed complex endophyte-associated plant or part thereof contains less of the undesirable substance when compared with reference agricultural plant. In a related embodiment, the improved trait can include improved taste of the plant or a part of the plant, including the fruit or seed. In a related embodiment, the improved trait can include reduction of undesirable compounds produced by other endophytes in plants, such as degradation of Fusarium-produced deoxynivalenol (also known as vomitoxin and a virulence factor involved in Fusarium head blight of maize and wheat) in a part of the plant, including the fruit or seed.

The designed complex endophyte- or endophytic component associated plant can also have an altered hormone status or altered levels of hormone production when compared with a reference agricultural plant. An alteration in hormonal status may affect many physiological parameters, including flowering time, water efficiency, apical dominance and/or lateral shoot branching, increase in root hair, and alteration in fruit ripening.

The association between the designed complex endophyte, or endophytic component, and the plant can also be detected using other methods known in the art. For example, the biochemical, metabolomics, proteomic, genomic, epigenomic and/or transcriptomic profiles of designed complex endophyte-associated plants can be compared with reference agricultural plants under the same conditions. Transcriptome analysis of designed complex endophyte-associated and reference agricultural plants can also be performed to detect changes in expression of at least one transcript, or a set or network of genes upon endophyte association. Similarly, epigenetic changes can be detected using methylated DNA immunoprecipitation followed by high-throughput sequencing.

Metabolomic differences between the plants can be detected using methods known in the art. The metabolites, proteins, or other compounds can be detected using any suitable method including, but not limited to gel electrophoresis, liquid and gas phase chromatography, either alone or coupled to mass spectrometry, NMR, immunoassays (enzyme-linked immunosorbent assays (ELISA)), chemical assays, spectroscopy, optical imaging techniques (such as magnetic resonance spectroscopy (MRS), magnetic resonance imaging (MRI), CAT scans, ultra sound, MS-based tissue imaging or X-ray detection methods (e.g., energy dispersive x-ray fluorescence detection)) and the like. In some embodiments, commercial systems for chromatography and NMR analysis are utilized. Such metabolomic methods can be used to detect differences in levels in hormone, nutrients, secondary metabolites, root exudates, phloem sap content, xylem sap content, heavy metal content, and the like. Such methods are also useful for detecting alterations in designed complex endophyteor endophytic component content and status; for example, the presence and levels of complex/fungal signaling molecules (e.g., autoinducers and pheromones), which can indicate the status of group-based behavior of endophytes based on, for example, population density.

Such methods are also useful for detecting alterations in designed complex endophyte content and status; for example, the presence and levels of complex/fungal signaling molecules (e.g., autoinducers and pheromones), which can indicate the status of group-based behavior of endophytes based on, for example, population density. Transcriptome analysis of endofungal bacterial endophyte-associated and reference agricultural plants can also be performed to detect changes in expression of at least one transcript, or a set or network of genes upon endofungal bacterial endophyte association. Similarly, epigenetic changes can be detected using methylated DNA immunoprecipitation followed by high-throughput sequencing. Any method known in the art may be utilized for such analyses. In some embodiments, a biological sample (whole tissue, exudate, phloem sap, xylem sap, root exudate, etc.) from designed complex endophyte-associated and reference agricultural plants can be analyzed essentially as known in the art.

In a particular embodiment, the metabolite can serve as a signaling or regulatory molecule. The signaling pathway can be associated with a response to a stress, for example, one of the stress conditions selected from the group consisting of drought stress, salt stress, heat stress, cold stress, low nutrient stress, nematode stress, insect herbivory stress, fungal pathogen stress, complex pathogen stress, and viral pathogen stress.

When the inoculated agricultural plant is grown under conditions such that the level of one or more metabolites is modulated in the plant, wherein the modulation may indicative of increased resistance to a stress selected from the group consisting of drought stress, salt stress, heat stress, cold stress, low nutrient stress, nematode stress, insect herbivory stress, fungal pathogen stress, complex pathogen stress, and viral pathogen stress. The increased resistance can be measured at about 10 minutes after applying the stress, between 10 minutes and 20 minutes, for example about 20 minutes, between 20 and 30 minutes, 30 minutes, between 30 and 45 minutes, about 45 minutes, between 45 minutes and 1 hour, about 1 hour, between 1 and 2 hours, about 2 hours, between 2 and 4 hours, about 4 hours, between 4 and 8 hours, about 8 hours, between 8 and 12 hours, about 12 hours, between 12 and 16 hours, about 16 hours, between 16 and 20 hours, about 20 hours, between 20 and 24 hours, about 24 hours, between 24 and 36 hours, about 36 hours, between 36 and 48 hours, about 48 hours, between 48 and 72 hours, about 72 hours, between 72 and 96 hours, about 96 hours, between 96 and 120 hours, about 120 hours, between 120 hours and one week, or about a week after applying the stress.

In some embodiments, metabolites in plants can be modulated by making synthetic combinations of plants with designed complex endophytes or endophytic components. For example, designed complex endophytes or endophytic components can cause a detectable modulation (e.g., an increase or decrease) in the level of various metabolites, e.g., indole-3-carboxylic acid, trans-zeatin, abscisic acid, phaseic acid, indole-3-acetic acid, indole-3-butyric acid, indole-3-acrylic acid, jasmonic acid, jasmonic acid methyl ester, dihydrophaseic acid, gibberellin A3, salicylic acid, upon colonization of a plant.

In some embodiments, designed complex endophytes or endophytic components modulate the level of the metabolite directly (e.g., the microbes produces the metabolite, resulting in an overall increase in the level of the metabolite found in the plant). In other cases, the agricultural plant, as a result of the association with the designed complex endophytes or endophytic components, exhibits a modulated level of the metabolite (e.g., the plant reduces the expression of a biosynthetic enzyme responsible for production of the metabolite as a result of the microbe inoculation). In still other cases, the modulation in the level of the metabolite is a consequence of the activity of both the microbe and the plant (e.g., the plant produces increased amounts of the metabolite when compared with a reference agricultural plant, and the endophyte also produces the metabolite). Therefore, as used herein, a modulation in the level of a metabolite can be an alteration in the metabolite level through the actions of the microbe and/or the inoculated plant.

The levels of a metabolite can be measured in an agricultural plant, and compared with the levels of the metabolite in a reference agricultural plant, and grown under the same conditions as the inoculated plant. The uninoculated plant that is used as a reference agricultural plant is a plant that has not been applied with a formulation with the designed complex endophytes or endophytic components (e.g., a formulation comprising designed complex endophytes or endophytic components). The uninoculated plant used as the reference agricultural plant is generally the same species and cultivar as, and is isogenic to, the inoculated plant.

The metabolite whose levels are modulated (e.g., increased or decreased) in the designed complex endophyte-associated plant may serve as a primary nutrient (i.e., it provides nutrition for the humans and/or animals who consume the plant, plant tissue, or the commodity plant product derived therefrom, including, but not limited to, a sugar, a starch, a carbohydrate, a protein, an oil, a fatty acid, or a vitamin). The metabolite can be a compound that is important for plant growth, development or homeostasis (for example, a phytohormone such as an auxin, cytokinin, gibberellin, a brassinosteroid, ethylene, or abscisic acid, a signaling molecule, or an antioxidant). In other embodiments, the metabolite can have other functions. For example, in some embodiments, a metabolite can have bacteriostatic, bactericidal, fungistatic, fungicidal or antiviral properties. In other embodiments, the metabolite can have insect-repelling, insecticidal, nematode-repelling, or nematicidal properties. In still other embodiments, the metabolite can serve a role in protecting the plant from stresses, may help improve plant vigor or the general health of the plant. In yet another embodiment, the metabolite can be a useful compound for industrial production. For example, the metabolite may itself be a useful compound that is extracted for industrial use, or serve as an intermediate for the synthesis of other compounds used in industry. In a particular embodiment, the level of the metabolite is increased within the agricultural plant or a portion thereof such that it is present at a concentration of at least 0.1 ug/g dry weight, for example, at least 0.3 ug/g dry weight, between 0.3 ug/g and 1.0 ug/g dry weight, at least 1.0 ug/g dry weight, between 1.0 ug/g and 3.0 ug/g dry weight, at least 3.0 ug/g dry weight, between 3.0 ug/g and 10 ug/g dry weight, at least 10 ug/g dry weight, between 10 ug/g and 30 ug/g dry weight, at least 30 ug/g dry weight, between 30 ug/g and 100 ug/g dry weight, at least 100 ug/g dry weight, between 100 ug/g and 300 ug/g dry weight, at least 300 ug/g dry weight, between 300 ug/g and 1 mg/g dry weight, or more than 1 mg/g dry weight, of the plant or portion thereof.

Likewise, the modulation can be a decrease in the level of a metabolite. The reduction can be in a metabolite affecting the taste of a plant or a commodity plant product derived from a plant (for example, a bitter tasting compound), or in a metabolite which makes a plant or the resulting commodity plant product otherwise less valuable (for example, reduction of oxalate content in certain plants, or compounds which are deleterious to human and/or animal health). The metabolite whose level is to be reduced can be a compound that affects quality of a commodity plant product (e.g., reduction of lignin levels).

Non-Agricultural Uses of Designed Complex Endophytes or Endophytic Components

In one embodiment of the present invention, designed complex endophytes or endophytic components may be used to improve the efficacy or utility of applications in which single microbe types are typically used. For example, a process that normally utilizes a particular fungus may benefit from substitution of a designed complex endophyte in that process, where the designed complex endophyte comprises that particular fungus as a host that itself further comprises a component bacterium. In another example, a process that normally utilizes a particular bacterium may benefit from substitution of a designed complex endophyte or endophytic component in that process, which comprises a fungal host that itself further comprises that particular bacterium.

It is contemplated that the mechanism of process or application improvement may result from one or more mechanisms, such as but not limited to: the incorporation of an additional organism (host fungus or component bacterium), a synergy between the two organisms (host fungus and component bacterium), a leveraging of a compound produced by one of the organisms that is utilized by the other, an additive effect between the two organisms (host fungus and component bacterium), a protective effect of one organism on the other, the induction, upregulation, or down-regulation of a particular biochemical or metabolic pathway in one or both organisms, the utilization of a different energy source as a result of the presence of the other organism, improved survivability of one or both organisms as a result of their association in a host: component relationship, or a combination of effects.

In one example, the process of baking bread, brewing beer, or fermenting a fruit or grain for alcohol production, is improved by the substitution of, or addition of, a designed complex endophyte or endophytic component comprising a component bacterium inside the traditional fungal strain.

In one example, the process pickling or curing foods is improved by the substitution of, or addition of, a designed complex endophyte or endophytic component comprising a host fungus further comprising the traditional bacterial strain.

In one example, the process of manufacturing or delivering insecticidal bacteria can be improved, by the substitution of, or addition of, a designed complex endophyte or endophytic component comprising a host fungus further comprising the traditional bacterial strain.

In one example, the process of wastewater treatment can be improved by the substitution of, or addition of, a designed complex endophyte or endophytic component comprising a host fungus further comprising the traditional bacterial strain.

In one example, the process of bioremediation of oils, plastics, or other chemicals can be improved by the substitution of, or addition of, a designed complex endophyte or endophytic component comprising a host fungus further comprising the traditional bacterial strain.

In one example, processes related to water quality improvement can be improved by the substitution of, or addition of, a designed complex endophyte or endophytic component comprising a host fungus further comprising the traditional bacterial strain.

In one example, the process of synthesis of biodegradable plastics can be improved by the substitution of, or addition of, a designed complex endophyte or endophytic component comprising a host fungus further comprising the traditional bacterial strain.

In one example, the process of composting biodegradable substances can be improved by the substitution of, or addition of, a designed complex endophyte or endophytic component comprising a host fungus further comprising the traditional bacterial strain.

In one example, the process of manufacturing or delivering pharmaceutical compounds for human or animal usage can be improved by the substitution of, or addition of, a designed complex endophyte or endophytic component comprising a component bacterium inside the traditional fungal strain.

In one example, the process of manufacturing industrial compounds (such as, but not limited to: enzymes, lipases, amylases, pectinases, amino acids, vitamins, antibiotics, acids, lactic acid, glutamic acid, citric acid alcohols, esters, flavoring agents, preservatives, nitrogen, viruses, sugars, biogas, bioplastic) can be improved by the substitution of, or addition of, a designed complex endophyte or endophytic component comprising a host fungus further comprising a bacterial strain for either the traditional bacterium or the traditional fungus.

In one example, the process of producing snow or ice can be improved by the substitution of, or addition of, a designed complex endophyte or endophytic component comprising a host fungus further comprising the traditional bacterial strain.

In one example, the process of manufacturing or delivering pharmaceutical compounds for human or animal usage can be improved by the substitution of, or addition of, a designed complex endophyte or endophytic component comprising a component bacterium inside the traditional fungal strain.

In one example, the process of manufacturing pharmaceutical compounds (such as, but not limited to: enzymes, amino acids, vitamins, antibiotics, hormones, insulin, human growth hormone, vaccines, preservatives, viruses) can be improved by the substitution of, or addition of, a designed complex endophyte or endophytic component comprising a host fungus further comprising a bacterial strain for either the traditional bacterium or the traditional fungus.

Formulations for Agricultural Use

The purified designed complex endophyte populations and their components described herein are intended to be useful in the improvement of agricultural plants, and as such, may be formulated with other compositions as part of an agriculturally compatible carrier. The carrier composition comprising the designed complex endophyte populations may be prepared for agricultural application as a liquid, a solid, or a gas formulation.

In one aspect, the carrier composition is contemplated as a vehicle for a method of association between the agricultural plant element and purified designed complex endophyte population. It is contemplated that such methods of association between the agricultural plant element and purified designed complex endophyte population can include, but not be limited to: seed treatment, root wash, seedling soak, foliar application, soil inocula, in-furrow application, sidedress application, soil pre-treatment, wound inoculation, drip tape irrigation, vector-mediation via a pollinator, injection, osmopriming, hydroponics, aquaponics, aeroponics.

A variety of applications, including but not limited to single carrier compositions, single methods of association, and combinations of carrier compositions and methods of association, are contemplated. In one non-limiting example, application of the designed complex endophyte population to the plant may be achieved, for example, as a powder for surface deposition onto plant leaves, as a spray to the whole plant or selected plant element, as part of a drip to the soil or the roots, or as a coating onto the plant element prior to planting. In another non-limiting example, a plant element may first become associated with a purified end designed complex endophyte ophyte population by virtue of seed treatment with a solid (dry) formulation comprising a purified end designed complex endophyte ophyte population, and upon germination and leaf emergence, the plant then be subjected to a foliar spray of a liquid formulation comprising a purified designed complex endophyte population. In another non-limiting example, a plant may become associated with a purified designed complex endophyte population by virtue of inoculation of the growth medium (soil or hydroponic) with a liquid or solid formulation comprising a purified designed complex endophyte population, and be subjected to repeated (two, three, four, or even five subsequent) inoculations with a liquid or solid formulation comprising a purified designed complex endophyte population. Any number of single carrier compositions and single methods of association, as well as combinations of carrier compositions and methods of association, are intended to be within the scope of the present invention, and as such, the examples given are meant to be illustrative and not limiting to the scope of the invention.

The formulation useful for these embodiments generally and typically include at least one member selected from the group consisting of: a buffer, a tackifier, a microbial stabilizer, a fungicide, an anticomplex agent, an herbicide, a nematicide, an insecticide, a bactericide, a virucide, a plant growth regulator, a rodenticide, a desiccant, and a nutrient.

The carrier can be a solid carrier or liquid carrier, and in various forms including microspheres, powders, emulsions and the like. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in a composition of the invention. Water-in-oil emulsions can also be used to formulate a composition that includes the purified population (see, for example, U.S. Pat. No. 7,485,451, which is incorporated herein by reference in its entirety). Suitable formulations that may be prepared include wettable powders, granules, gels, agar strips or pellets, thickeners, biopolymers, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or a plant growth medium. Other agricultural carriers that may be used include water, fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pesta (flour and kaolin clay), agar or flour-based pellets in loam, sand, or clay, etc. Formulations may include food sources for the cultured organisms, such as barley, rice, or other biological materials such as seed, plant elements, sugar cane bagasse, hulls or stalks from grain processing, ground plant material or wood from building site refuse, sawdust or small fibers from recycling of paper, fabric, or wood. Other suitable formulations will be known to those skilled in the art.

In an embodiment, the formulation can include a tackifier, sticker, or adherent. Such agents are useful for combining the complex population of the invention with carriers that can contain other compounds (e.g., control agents that are not biologic), to yield a coating composition. Such compositions help create coatings around the plant or plant element to maintain contact between the endophyte and other agents with the plant or plant element. In one embodiment, adherents (stickers, or tackifiers) are selected from the group consisting of: alginate, gums, starches, lecithins, formononetin, polyvinyl alcohol, alkali formononetinate, hesperetin, polyvinyl acetate, cephalins, Gum Arabic, Xanthan Gum, carragennan, PGA, other biopolymers, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers. Other examples of adherent compositions that can be used in the synthetic preparation include those described in EP 0818135, CA 1229497, WO 2013090628, EP 0192342, WO 2008103422 and CA 1041788, each of which is incorporated herein by reference in its entirety.

It is also contemplated that the formulation may further comprise an anti-caking agent.

The formulation can also contain a surfactant, wetting agent, emulsifier, stabilizer, or anti-foaming agent. Non-limiting examples of surfactants include nitrogen-surfactant blends such as Prefer 28 (Cenex), Surf-N (US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision), polysorbate 20, polysorbate 80, Tween 20, Tween 80, Scattics, Alktest TW20, Canarcel, Peogabsorb 80, Triton X-100, Conco NI, Dowfax 9N, Igebapl CO, Makon, Neutronyx 600, Nonipol NO, Plytergent B, Renex 600, Solar NO, Sterox, Serfonic N, T-DET-N, Tergitol NP, Triton N, IGEPAL CA-630, Nonident P-40, Pluronic. In one embodiment, the surfactant is present at a concentration of between 0.01% v/v to 10% v/v. In another embodiment, the surfactant is present at a concentration of between 0.1% v/v to 1% v/v. An example of an anti-foaming agent would be Antifoam-C.

In certain cases, the formulation includes a microbial stabilizer. Such an agent can include a desiccant. As used herein, a "desiccant" can include any compound or mixture of compounds that can be classified as a desiccant regardless of whether the compound or compounds are used in such concentrations that they in fact have a desiccating effect on the liquid inoculant. Such desiccants are ideally compatible with the population used, and should promote the ability of the endophyte population to survive application on the seeds and to survive desiccation. Examples of suitable desiccants include one or more of trehalose, sucrose, glycerol, and methylene glycol. Other suitable desiccants include, but are not limited to, non-reducing sugars and sugar alcohols (e.g., mannitol or sorbitol). The amount of desiccant introduced into the formulation can range from about 5% to about 50% by weight/volume, for example, between about 10% to about 40%, between about 15% and about 35%, or between about 20% and about 30%.

In some cases, it is advantageous for the formulation to contain agents such as a fungicide, an anticomplex agent, an herbicide, a nematicide, an insecticide, a plant growth regulator, a rodenticide, a bactericide, a virucide, or a nutrient. Such agents are ideally compatible with the agricultural plant element or seedling onto which the formulation is applied (e.g., it should not be deleterious to the growth or health of the plant). Furthermore, the agent is ideally one which does not cause safety concerns for human, animal or industrial use (e.g., no safety issues, or the compound is sufficiently labile that the commodity plant product derived from the plant contains negligible amounts of the compound).

Nutrient additives to the formulation may include fertilizer compositions such as, but not limited to, nitrogen, phosphorous, or potassium.

In the liquid form, for example, solutions or suspensions, endophyte populations of the present invention can be mixed or suspended in water or in aqueous solutions. Suitable liquid diluents or carriers include water, aqueous solutions, petroleum distillates, or other liquid carriers.

Solid compositions can be prepared by dispersing the endophyte populations of the invention in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils such as soybean oil and cottonseed oil, glycerol, ethylene glycol, polyethylene glycol, propylene glycol, polypropylene glycol, etc.

In an embodiment, the formulation is ideally suited for coating of a population of designed complex endophytes onto plant elements. The designed complex endophyte populations described in the present invention are capable of conferring many fitness benefits to the host plants. The ability to confer such benefits by coating the populations on the surface of plant elements has many potential advantages, particularly when used in a commercial (agricultural) scale.

The designed complex endophyte populations herein can be combined with one or more of the agents described above to yield a formulation suitable for combining with an agricultural plant element, seedling, or other plant element. Designed complex endophyte populations can be obtained from growth in culture, for example, using a synthetic growth medium. In addition, designed complex endophytes or their components can be cultured on solid media, for example on petri dishes, scraped off and suspended into the preparation. Endophytes at different growth phases can be used. For example, microbes at lag phase, early-log phase, mid-log phase, late-log phase, stationary phase, early death phase, or death phase can be used. Endophytic spores may be used for the present invention, for example but not limited to: arthospores, sporangispores, conidia, chlamadospores, pycnidiospores, endospores, zoospores.

The formulations comprising designed complex endophyte weight, for example, between about 1% and 90%, between about 3% and 75%, between about 5% and 60%, between about 10% and 50% in wet weight of the designed complex endophyte population of the present invention.

In one embodiment, it is contemplated that the formulation comprises at least about $10^2$ CFU or spores designed complex endophyte population per mL of liquid formulation, between $10^2$ and $10^3$ CFU or spores per mL, about $10^3$ CFU or spores per mL, between $10^3$ and $10^4$ CFU or spores per mL, about $10^4$ CFU or spores per mL, between $10^4$ and $10^5$ CFU or spores per mL, about $10^5$ CFU or spores per mL, between $10^5$ and $10^6$ and $10^7$ CFU or spores per mL, about $10^7$ CFU or spores per mL, between $10^7$ and $10^8$ CFU or spores per mL, about $10^8$ CFU or spores per mL, between $10^8$ and $10^9$ CFU or spores per mL, or even greater than $10^9$ CFU or spores designed complex endophyte population per mL of liquid formulation.

In one embodiment, it is contemplated that the formulation comprises at least about $10^2$ CFU or spores designed complex endophyte population per gram of non-liquid formulation, between $10^2$ and $10^3$ CFU or spores per gram, about $10^3$ CFU or spores per gram, between $10^3$ and $10^4$ CFU or spores per gram, about $10^4$ CFU or spores per gram, between $10^4$ and $10^5$ CFU or spores per gram, about $10^5$ CFU or spores per gram, between $10^5$ and $10^6$ CFU or spores per gram, about $10^6$ CFU or spores per gram, between $10^6$ and $10^7$ CFU or spores per gram, $10^7$ CFU or spores per gram, about $10^7$ CFU or spores per gram, between $10^7$ and $10^8$ CFU or spores per gram, about $10^8$ CFU or spores per gram, between $10^8$ and $10^9$ CFU or spores per gram, or even greater than $10^9$ CFU or spores designed complex endophyte population per gram of non-liquid formulation.

In one embodiment, it is contemplated that the formulation be applied to the plant element at about $10^2$ CFU or spores/seed, between $10^2$ and $10^3$ CFU or spores, at least about $10^3$ CFU or spores, between $10^3$ and $10^4$ CFU or spores, at least about $10^4$ CFU or spores, between $10^4$ and $10^5$ CFU or spores, at least about $10^5$ CFU or spores, between $10^5$ and $10^6$ CFU or spores, at least about $10^6$ CFU or spores, between $10^6$ and $10^7$ CFU or spores, at least about $10^7$ CFU or spores, between $10^7$ and $10^8$ CFU or spores, or even greater than $10^8$ CFU or spores per seed.

Designed Complex Endophyte Fungal Hosts as Formulation Components

One aspect of the present invention contemplates the utility of the fungal host in the designed complex endophyte system as a formulation carrier moiety for the component bacterium.

Bacteria can exhibit varying physiological characteristics, that can depend upon the strain or the genus or the species, or upon other factors such as growth phase of the colony or population density. Some bacteria are more or less sensitive to environmental conditions than others. For example, certain bacteria are thermally sensitive, and not able to tolerate different ranges of, or changes in, environmental temperature. In another example, certain bacteria are unable tolerate different ranges of, or changes in, environmental moisture content. In another example, certain bacteria are unable tolerate different ranges of, or changes in, environmental acidity or alkalinity. In another example, certain bacteria are unable tolerate different ranges of, or changes in, nutrient composition.

Encapsulation of a bacterium within a host fungus to create a designed complex endophyte can cover several novel advantages to the component bacterium, to the host fungus, or to both organisms. In one aspect, the host fungus and the component bacterium have a symbiotic relationship, a mutualistic relationship, a commensal relationship, or one organism may be parasitic to the other.

In one aspect of the present invention, the component bacterium of a designed complex endophyte displays greater survivability as compared to a heterologous bacterium not encapsulated in a host fungus. In another aspect, the component bacterium is able to utilize a different nutrient source than an isoline bacterium not encapsulated within a host fungus. In another aspect, the component bacterium produces a different set of transcripts, metabolites, proteins, hormones, or other compounds as compared to an isoline bacterium not encapsulated in a host fungus. The host fungus may provide the component bacterium protection from environmental variables such as variations in temperature or moisture, chemicals, hostile organisms such as other bacteria or viruses, or other factors. In one aspect, the host fungus produces a compound that enables the component bacterium to display improved survivability or other physiological or phenotypic improvement.

In one aspect, the host fungus provides protection to the component bacterium from bactericidal compositions, such as those that may be found in an agricultural formulation. In one aspect, the host fungus provides a nutritional environment that the bacterium can leverage. In one aspect, the host fungus provides an optimal environment for the bacterium to form spores or crystal proteins. In one aspect, the host fungus protects the bacterium from desiccation. In one aspect, the host fungus provides an optimal pH environment for the component bacterium.

In another aspect, the component bacterium imparts a benefit to the host fungus, as compared to an isoline fungus not comprising said bacterium.

In one aspect, the component bacterium provides amelioration to the host fungus for something detrimental to the environment. For example, the component bacterium may protect the host fungus from a fungicide, such as from an agricultural formulation, by virtue of producing an ameliorating compound. In one aspect, the component bacterium provides a nutritional environment to the host bacterium. In one aspect, the component bacterium produces a compound that enables the host fungus to display improved survivability or other physiological or phenotypic improvement.

Populations of Plant Elements

In another embodiment, the invention provides for a substantially uniform population of plant elements (PEs) comprising two or more PEs comprising the designed complex endophyte population, as described herein above. Substantial uniformity can be determined in many ways. In some cases, at least 10%, between 10% and 20%, for example, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the PEs in the population, contains the designed complex endophyte population in an amount effective to colonize the plant disposed on the surface of the PEs. In other cases, at least 10%, between 10% and 20%, for example, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plant element s in the population, contains at least 1, between 1 and 10, 10, between 10 and 100, or 100 CFU on the plant element surface or per gram of plant element, for example, between 100 and 200 CFU, at least 200 CFU, between 200 and 300 CFU, at least 300 CFU, between 300 and 1,000 CFU, at least 1,000 CFU, between 1,000 and 3,000 CFU, at least 3,000 CFU, between 3,000 and 10,000 CFU, at least 10,000 CFU, between 10,000 and 30,000 CFU, at least 30,000 CFU, between 30,000 and 100,000 CFU, at least 100,000 CFU, between 100,000 and 300,000 CFU, at least 300,000 CFU, between 300,000 and 1,000,000 CFU, or at least 1,000,000 CFU per plant element or more.

In a particular embodiment, the population of plant elements is packaged in a bag or container suitable for commercial sale. Such a bag contains a unit weight or count of the plant elements comprising the designed complex endophyte population as described herein, and further comprises a label. In an embodiment, the bag or container contains at least 100 plant elements, between 100 and 1,000 plant elements, 1,000 plant elements, between 1,000 and 5,000 plant elements, for example, at least 5,000 plant elements, between 5,000 and 10,000 plant elements, at least 10,000 plant elements, between 10,000 and 20,000 plant elements, at least 20,000 plant elements, between 20,000 and 30,000 plant elements, at least 30,000 plant elements, between 30,000 and 50,000 plant elements, at least 50,000 plant elements, between 50,000 and 70,000 plant elements, at least 70,000 plant elements, between 70,000 and 80,000 plant elements, at least 80,000 plant elements, between 80,000 and 90,000, at least 90,000 plant elements or more. In another embodiment, the bag or container can comprise a discrete weight of plant elements, for example, at least 1 lb, between 1 and 2 lbs, at least 2 lbs, between 2 and 5 lbs, at least 5 lbs, between 5 and 10 lbs, at least 10 lbs, between 10 and 30 lbs, at least 30 lbs, between 30 and 50 lbs, at least 50 lbs, between 50 and 70 lbs, at least 70 lbs or more. The bag or container comprises a label describing the plant elements and/or said endophytic population. The label can contain additional information, for example, the information selected from the group consisting of: net weight, lot number, geographic origin of the plant elements, test date, germination rate, inert matter content, and the amount of noxious weeds, if any. Suitable containers or packages include those traditionally used in plant seed commercialization. The invention also contemplates other containers with more sophisticated storage capabilities (e.g., with microbiologically tight wrappings or with gas- or waterproof containments).

In some cases, a sub-population of plant elements comprising the designed complex endophyte population is further selected on the basis of increased uniformity, for example, on the basis of uniformity of microbial population. For example, individual plant elements of pools collected from individual cobs, individual plants, individual plots (representing plants inoculated on the same day) or individual fields can be tested for uniformity of microbial density, and only those pools meeting specifications (e.g., at least 80% of tested plant elements have minimum density, as determined by quantitative methods described elsewhere) are combined to provide the agricultural plant elements sub-population.

The methods described herein can also comprise a validating step. The validating step can entail, for example, growing some plant elements collected from the inoculated plants into mature agricultural plants, and testing those individual plants for uniformity. Such validating step can be performed on individual s plant elements seeds collected from cobs, individual plants, individual plots (representing plants inoculated on the same day) or individual fields, and tested as described above to identify pools meeting the required specifications.

In some embodiments, methods described herein include planting a synthetic combination described herein. Suitable planters include an air seeder and/or fertilizer apparatus used in agricultural operations to apply particulate materials including one or more of the following, seed, fertilizer and/or inoculants, into soil during the planting operation. Seeder/fertilizer devices can include a tool bar having ground-engaging openers thereon, behind which is towed a wheeled cart that includes one or more containment tanks or bins and associated metering means to respectively contain and meter therefrom particulate materials. See, e.g., U.S. Pat. No. 7,555,990.

In certain embodiments, a composition described herein may be in the form of a liquid, a slurry, a solid, or a powder (wettable powder or dry powder). In another embodiment, a composition may be in the form of a seed coating. Compositions in liquid, slurry, or powder (e.g., wettable powder) form may be suitable for coating seeds. When used to coat seeds, the composition may be applied to the seeds and allowed to dry. In embodiments wherein the composition is a powder (e.g., a wettable powder), a liquid, such as water, may need to be added to the powder before application to a seed.

In still another embodiment, the methods can include introducing into the soil an inoculum of one or more of the endophyte populations described herein. Such methods can include introducing into the soil one or more of the compositions described herein. The inoculum(s) or compositions may be introduced into the soil according to methods known to those skilled in the art. Non-limiting examples include in-furrow introduction, spraying, coating seeds, foliar introduction, etc. In a particular embodiment, the introducing step comprises in-furrow introduction of the inoculum or compositions described herein.

In an embodiment, plant elements may be treated with composition(s) described herein in several ways, for example via spraying or dripping. Spray and drip treatment may be conducted by formulating compositions described herein and spraying or dripping the composition(s) onto a seed(s) via a continuous treating system (which is calibrated to apply treatment at a predefined rate in proportion to the continuous flow of seed), such as a drum-type of treater. Batch systems, in which a predetermined batch size of seed and composition(s) as described herein are delivered into a mixer, may also be employed.

In another embodiment, the treatment entails coating plant elements. One such process involves coating the inside wall of a round container with the composition(s) described herein, adding plant elements, then rotating the container to cause the plant elements to contact the wall and the composition(s), a process known in the art as "container coating." Plant elements can be coated by combinations of coating methods. Soaking typically entails using liquid forms of the compositions described. For example, plant elements can be soaked for about 1 minute to about 24 hours (e.g., for at least 1 min, between 1 and 5 min, 5 min, between 5 and 10 min, 10 min, between 10 and 20 min, 20 min, between 20 and 40 min, 40 min, between 40 and 80 min, 80 min, between 80 min and 3 hrs, 3 hrs, between 3 hrs and 6 hrs, 6 hr, between 6 hrs and 12 hrs, 12 hr, between 12 hrs and 24 hrs, 24 hrs).

Population of Plants/Agricultural Fields

A major focus of crop improvement efforts has been to select varieties with traits that give, in addition to the highest return, the greatest homogeneity and uniformity. While inbreeding can yield plants with substantial genetic identity, heterogeneity with respect to plant height, flowering time, and time to seed, remain impediments to obtaining a homogeneous field of plants. The inevitable plant-to-plant variability is caused by a multitude of factors, including uneven environmental conditions and management practices. Another possible source of variability can, in some cases, be due to the heterogeneity of the designed complex endophytic or endophytic component population inhabiting the plants. By providing designed complex endophyte or endophytic component populations onto plant reproductive elements, the resulting plants generated by germinating the plant reproductive elements have a more consistent designed complex endophyte composition, and thus are expected to yield a more uniform population of plants.

Therefore, in another embodiment, the invention provides a substantially uniform population of plants. The population can include at least 10 plants, between 10 and 100 plants, for example, at least 100 plants, between 100 and 300 plants, at least 300 plants, between 300 and 1,000 plants, at least 1,000 plants, between 1,000 and 3,000 plants, at least 3,000 plants, between 3,000 and 10,000 plants, at least 10,000 plants, between 10,000 and 30,000 plants, at least 30,000 plants, between 30,000 and 100,000 plants, at least 100,000 plants or more. The plants are derived from plant reproductive elements comprising endophyte populations as described herein. The plants are cultivated in substantially uniform groups, for example in rows, groves, blocks, circles, or other planting layout. The plants are grown from plant reproductive elements comprising the designed complex endophyte population as described herein. The uniformity of the plants can be measured in a number of different ways.

The uniformity of the plants can be measured in a number of different ways. In one embodiment, there is an increased uniformity with respect to endophytes within the plant population. For example, in one embodiment, a substantial portion of the population of plants, for example at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plant elements or plants in a population, contains a threshold number of an endophyte population. The threshold number can be at least 10 CFU, between 10 and 100 CFU, at least 100 CFU, between 100 and 300 CFU, for example at least 300 CFU, between 300 and 1,000 CFU, at least 1,000 CFU, between 1,000 and 3,000 CFU, at least 3,000 CFU, between 3,000 and 10,000 CFU, at least 10,000 CFU, between 10,000 and 30,000 CFU, at least 30,000 CFU, between 30,000 and 100,000 CFU, at least 100,000 CFU or more, in the plant or a part of the plant. Alternatively, in a substantial portion of the population of plants, for example, in at least 1%, between 1% and 10%, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plants in the population, the endophyte population that is provided to the seed or seedling represents at least 0.1%, between 0.1% and 1% at least 1%, between 1% and 5%, at least 5%, between 5% and 10%, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 80%, at least 80%, between 80% and 90%, at least 90%, between 90% and 95%, at least 95%, between 95% and 99%, at least 99%, between 99% and 100%, or 100% of the total endophyte population in the plant/seed.

In one embodiment, there is increased genetic uniformity of a substantial proportion or all detectable designed complex endophytes or endophytic components within the taxa, genus, or species of the designed complex endophyte fungus or component relative to an uninoculated control. This increased uniformity can be a result of the designed complex endophyte being of monoclonal origin or otherwise deriving from a population comprising a more uniform genome sequence and plasmid repertoire than would be present in the designed complex endophyte population a plant that derives its endophyte community largely via assimilation of diverse soil symbionts.

In another embodiment, there is an increased uniformity with respect to a physiological parameter of the plants within the population. In some cases, there can be an increased uniformity in the height of the plants when compared with a population of reference agricultural plants grown under the same conditions. For example, there can be a reduction in the standard deviation in the height of the plants in the population of at least 5%, between 5% and 10%, for example, at least 10%, between 10% and 15%, at least 15%, between 15% and 20%, at least 20%, between 20% and 30%, at least 30%, between 30% and 40%, at least 40%, between 40% and 50%, at least 50%, between 50% and 60%, at least 60% or more, when compared with a population of reference agricultural plants grown under the same conditions. In other cases, there can be a reduction in the standard deviation in the flowering time of the plants in the population of at least 5%, between 5% and 10%, for example, at least 10%, between 10% and 15%, at least 15%, between 15% and 20%, at least 20%, between 20% and 30%, at least 30%, between 30% and 40%, at least 40%, between 40% and 50%, at least 50%, between 50% and 60%, at least 60% or more, when compared with a population of reference agricultural plants grown under the same conditions.

Commodity Plant Products

The present invention provides a commodity plant product, as well as methods for producing a commodity plant product, that is derived from a plant of the present invention. As used herein, a "commodity plant product" refers to any composition or product that is comprised of material derived from a plant, seed, plant cell, or plant part of the present invention. Commodity plant products may be sold to consumers and can be viable or nonviable. Nonviable commodity products include but are not limited to nonviable seeds and grains; processed seeds, seed parts, and plant parts; dehydrated plant tissue, frozen plant tissue, and processed plant tissue; seeds and plant parts processed for animal feed for terrestrial and/or aquatic animal consumption, oil, meal, flour, flakes, bran, fiber, paper, tea, coffee, silage, crushed of whole grain, and any other food for human or animal consumption; and biomasses and fuel products; and raw material in industry. Industrial uses of oils derived from the agricultural plants described herein include ingredients for paints, plastics, fibers, detergents, cosmetics, lubricants, and biodiesel fuel. Soybean oil may be split, inter-esterified, sulfurized, epoxidized, polymerized, ethoxylated, or cleaved. Designing and producing soybean oil derivatives with improved functionality and improved oliochemistry is a rapidly growing field. The typical mixture of triglycerides is usually split and separated into pure fatty acids, which are then combined with petroleum-derived alcohols or acids, nitrogen, sulfonates, chlorine, or with fatty alcohols derived from fats and oils to produce the desired type of oil or fat. Commodity plant products also include industrial compounds, such as a wide variety of resins used in the formulation of adhesives, films, plastics, paints, coatings and foams.

Although the present invention has been described in detail with reference to examples below, it is understood that various modifications can be made without departing from the spirit of the invention. For instance, while the particular examples below may illustrate the methods and embodiments described herein using a specific plant, the principles in these examples may be applied to any agricultural crop. Therefore, it will be appreciated that the scope of this invention is encompassed by the embodiments of the inventions recited herein and the specification rather than the specific examples that are exemplified below. All cited patents and publications referred to in this application are herein incorporated by reference in their entirety

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

Example 1: Isolation of Endophyte Components and Designed Complex Endophytes

Isolation followed the methods described in Hoffman and Arnold (2010, Appl. Environ. Microbiol. 76: 4063-4075). Briefly, fresh, asymptomatic tissue was collected from at least three healthy, mature individuals of each focal species. Material was transferred to the laboratory for processing within 6 to 12 h of collection. Tissue samples were washed in running tap water and then cut into 2-mm segments. Segments were surface sterilized by rinsing in 95% ethanol for 30 s, 10% Clorox (0.6% sodium hypochlorite) for 2 min, and 70% ethanol for 2 min, allowed to surface dry under sterile conditions, and plated on 2% malt extract agar (MEA), which encouraged growth by a diversity of endophytes.

Two strains of endofungal fungi (SYM16670 and SYM15779) and one strain of non-endofungal fungus (SYM15890) were isolated. Endofungal fungi were cured of their component bacterium as follows. SYM 16670, SYM 15779, and SYM 15890 were first assessed for the presence of endohyphal bacteria by PCR amplification of bacterial 16S rRNA gene. An individual plug of young mycelial tissue was placed at the center of 2% Maltose Extract Agar (MEA) amended with carbenicillin (0.1 mg/mL), kanamycin (0.05 mg/mL), tetracycline (0.01 mg/mL) and ciprofloxacin (0.04 mg/mL) and incubated at 25° C. for 7 days. All samples were plated in five replicates.

Fungal isolates were examined after 1 week of growth in pure culture on 2% MEA using a light microscope with bright-field imaging (400×; numerical aperture [NA]=0.75). Clear morphological differences were observed between the cured endofungi relative to the native forms (FIG. 1). Fungal culture samples were isolated from the surface of cultures of native, cured, and inoculated pure samples. Samples were scraped from the culture plate surface and were placed onto slides, and stained according to methods known in the art, rinsed, and coverslipped with 50% glycerol/50% water mixture. Images were acquired on a Nikon inverted microscope with FITC and Rhodamine filters and a mercury/xenon fluorescent light source. Images were captured on a Nikon D80 color DLSR using Nikon Capture software. Exposure times for each channel were identified for the native cultures and used for all subsequent imaging. Brightfield images were captured with FITC filter in place. Individual images were sequentially acquired. Brightfield images were modified to greyscale and image levels were modified in Adobe Photoshop for clarity.

At the end of the incubation period, genomic DNA was isolated from all fungal samples and tested for PCR amplification of bacterial 16S rRNA gene. Genomic DNA obtained from successfully cured endofungal samples did not yield a 16S rRNA gene PCR product and were used as the host fungi for subsequent work. The absence of a 16S rRNA gene amplicon from PCR using SYM 15890 genomic DNA was consistent.

Endofungal bacteria were isolated from their host fungi as follows. An individual plug of young mycelial tissue of SYM 16670, SYM 15779, and SYM 15890 was placed at the center of 2.4% PDA plates and incubated at 36° C. for 72 hours. In an improvement to this method, some complex endophytes were also incubated at 23.5° C. for 3-5 days to demonstrate efficacy of the method improvement.

The emergence of endohyphal bacteria from the hyphae of SYM 16670 and SYM 15779 was evident beginning 2 days of incubation. SYM 15890 did not appear to harbor any endohyphal bacteria. All samples were plated in five replicates. The isolated endohyphal bacteria were streaked on LB agar for propagation and maintenance as pure bacterial isolates.

Example 2: Identification of Designed Complex Endophyte Component Fungi and Bacteria Total genomic DNA was extracted from individual fungal isolates obtained as described above, using the Qiagen DNeasy Plant Mini Kit. PCR was used to amplify the nuclear ribosomal internal transcribed spacers (ITS) and the 5.8S gene (ITS ribosomal DNA [rDNA]) and when possible the first 600 bp of the large subunit (LSU rDNA) as a single fragment (ca. 1,000 to 1,200 bp in length) using the primers ITS1F and ITS4 or LR3. Each 25 microliter reaction mixture included 22.5 microliters of Invitrogen Platinum Taq supermix, 0.5 microliter of each primer (10 uM), and 1.5 microliter of DNA template (~2-4 ng). Cycling reactions were run with MJ Research PTC thermocyclers and consisted of 94° C. for 5 min, 35 cycles of 94° C. for 30 s, 54° C. for 30 s, and 72° C. for 1 min, and 72° C. for 10 min. Sanger sequencing was performed using an ABI 3730xl DNA Analyzers for capillary electrophoresis and fluorescent dye terminator detection. Sequences were compared with available sequences in GenBank using BLAST and a 97% similarity with 100% coverage is used as a cutoff threshold for species assignment.

The presence or absence of bacteria within the surrounding matrix was determined initially using light microscopy. Fungal isolates were examined after 1 week of growth in pure culture on 2% MEA using a light microscope with bright-field imaging (400×; numerical aperture [NA]=0.75). Once visual examination ruled out non-endofungal bacteria (i.e., contaminants in the medium or microbes on fungal surfaces), total genomic DNA extracted from fresh mycelia was examined using PCR primers specific to bacterial 16S rRNA genes, 27F and 1429R (1,402 bp). PCR mixes, cycling parameters and sequencing were as described above, except that annealing temperature was 55° C.

Colony PCR was performed on isolates of bacteria from supernatants of mycelial centrifugation (see above), by gently touching the surface of a colony with a sterile toothpick and using it to stir 2 microliters of nuclease-free water that then are used as a template for a 25 microliter PCR. The PCR, cycling parameters and sequencing were performed as described above using the 16S bacterial primers. Sequences were compared with the ones obtained from fungal total genomic DNA and with those deposited in GenBank using BLAST.

Bacterial cultures from non-endofungal sources were obtained and sequenced as above.

Bacterial endophytes of the present invention that are contemplated as being capable of functioning as component bacteria in a designed complex endophyte are described by their characteristic 16S sequences SEQ ID NO: 1 to 549 in Table 1.

Fungal endophytes of the present invention that are contemplated as being capable of functioning as host fungi in a designed complex endophyte are described by their characteristic ITS or LSU sequences SEQ ID NO: 550 through 747 in Table 2.

Pictures of the culture plates of each of the isolated complex endophyte cured fungi and isolated bacteria, as compared to their parent complex endophyte cultures, are shown in FIG. 2.

Pictures of the culture plates of each of the fungi and bacteria that were isolated from other sources and not part of any complex endophyte are shown in FIG. 3.

Example 3: Synthesis of Designed Complex Endophytes

Method of Culturing Cured Fungal Strains for Co-Culture

Three fungal strains were selected as potential candidate fungal hosts for the designed complex endophyte experiments. These included SYM15779 (a known, naturally-occurring complex endophyte comprising EHB15779), SYM166 (a known, naturally-occurring complex endophyte comprising EHB166), and SYM15890 (a fungus not known to further comprise component bacteria).

A single plug of young mycelial tissue of cured fungal strains was placed in 100 mL 2.4% PDB, and blended using a Waring blender on low settings for 5 seconds. The blended cured fungal plugs were grown for 10 days at 27° C. at 100 RPM constant agitation in preparation for the strains to be hosts for co-culturing with bacteria.

Method of Culturing Bacteria for Co-Culture

Four bacteria were selected as potential introduction candidates into cured fungal hosts for the designed complex endophyte experiments. These included endohyphal bacterium 16660 (also called EHB166, the bacterium isolated from SYM 16670), EHB15779 (bacterium isolated from SYM 15779), SYM 257, and SYM 292. A single colony of bacterium for each strain was first streaked onto LB agar to ensure purity of isolates. Similarly a single colony from the LB agar was used to inoculate 5 mL of LB for at 36° C. with constant agitation (200 RPM) for 3 days.

Method of Co-Culturing and Inoculation of Fungi with Bacteria

After the end of incubation, the fungal host strains were filtered through vacuum onto a #2 Whatman filter paper to obtain fungal biomass. The filtered fungal mycelia were washed twice using 10 mM $MgCl_2$. Following the washes, the mycelial biomass was resuspended in 2.4% PDB and blended using a Waring blender on low settings for 5 seconds. The resuspended fungal biomass was quantified at 600 nm using a spectrophotometer for absorbance measurements.

The bacteria in LB was harvested by centrifugation at 4256 RCF for 20 minutes, followed by the removal of supernatant and two rinses of 4 mL of 10 mM $MgCl_2$. The bacteria were resuspended in 4 mL 0.024% PDB and the absorbance measured at 600 nm using a spectrophotometer.

The co-culture of fungi and bacterium were made at a 5:1 fungus:bacterium ratio per the absorbance measurement, and brought up to a final volume of 5 mL using 2.4% PDB in 50 mL Falcon tubes. Each co-culture treatment was done in 5 replicates. Co-culture were grown for 7 days at 27° C. at 100 RPM constant agitation. After growth period, 0.2 mL of co-culture material were plated at the center of 2% water agar plates and were incubated at 27° C. for 2 weeks. Each treatment was done in three replicate. At the end of the 2 weeks, plugs were taken from the growing edge of fungal colonies and placed in 2.4% PDA and incubated for one week at 25° C. to screen for emergence of introduced endofungal bacteria.

Designed complex endophytes of the present invention that comprise a host fungus further comprising a component bacterium are described in Table 3.

Designer Endofungal Endophyte Culture Method for Production

Designer endofungal endophytes, cured fungal hosts, and bacteria used for co-culture were grown in Erlenmeyer flasks containing 150 mL of 2.4% potato dextrose broth (PDB) at 25° C. with constant agitation (130 RPM) for 13 days, and 4 days respectively.

FIG. 4 demonstrates the successful incorporation of a bacterium into a host fungus.

There are several improvements to this methodology that the inventors developed, which resulted in improved synthesis and quality of the designed complex endophytes. To minimize the contaminating effects of any surface bacteria on the fungi, it is important to remove any bacteria on the extracellular surface of the fungal mycelial cells prior to the extraction of nucleic acid to verify the presence of intracellular bacteria (endofungal bacteria), and prior to the creation of novel designed complex endophytes.

In the first improvement, the native endofungal endophyte or the fungal endophyte to be used as a designer endophyte fungal host is cultured with Gentamicin. Gentamicin is an antibiotic that does not penetrate eukaryotic cell membranes but does penetrate prokaryotic cell membranes. Therefore, any bacteria that are present on the surface of a fungus, but not encapsulated within a fungus, will be killed by the gentamicin and removed by the washing steps of these methods. It is important to reduce the amount of surface bacterial contamination on the fungal endophytes, to allow the fungus to grow sufficiently in culture without the contaminating bacteria proliferating and overtaking the culture media.

The samples used to develop this protocol included:
a known non-complex endophyte fungus (SYM15890)
a known complex endophyte (fungus SYM15779 comprising non-reintroduced, native EHB15779)

As comparison samples, the following were run:
SYM15890, that was subjected to a fungal curing step to verify non-endofungal bacterial presence, was spiked with 0.1 or 0.2 mL of isolated bacterium SYM292 and treated with 0.05 mg/mL gentamicin in liquid culture
SYM15890 spiked with 0.1 or 0.2 mL of isolated bacterium SYM292 and treated with 0.075 mg/mL gentamicin in liquid culture
SYM15890 spiked with 0.1 or 0.2 mL of isolated bacterium SYM292, without any wash treatment
SYM15779, both the isolated complex endophyte and the fungal host cured of component bacteria, treated with different concentrations of gentamicin The samples were treated and prepared according to the following novel methodology developed by the inventors:

Fungal mycelia were washed using 1 mL 10 mM $MgCl_2$ twice in microfuge tubes. Samples were centrifuged at 16,110 RPM at room temperature for 3 minutes and the solution decanted. The residual solution was pipetted out. Samples were incubated in either 0.05 mg/mL or 0.075 mg/mL Gentamicin, prepared with 50 mM Phosphate Saline Buffer, pH 7.0 for 1 hour. 0.2 mL solution was determined to be sufficient.

DNase I cocktail was prepared by the addition of 5 μL of DNase I and 5 μL 10× DNAse Buffer (DNAse I cocktail) per treatment. When five samples were being treated, a microfuge tube of 25 μL (5×5 μL) of each solution was prepared. Solutions were stored in the refrigerator (4° C.) until use.

Following incubation in the antibiotic solution, the solution was decanted. A minimum of 0.1 mL $MgCl_2$ per tube was added to thoroughly immerse the sample, and 10 μL of the DNAse I cocktail was immediately added for each sample. Samples were incubated for 15 minutes.

Proteinase K (10 mg/mL final concentration) in 10 mM $MgCl_2$ (Proteinase K cocktail) was prepared, in enough volume to add 0.2 mL/sample.

DNAse I solution was removed from the tubes after incubation time, via decanting or pipetting.

Proteinase K wash was conducted by adding at least 0.2 mL of the Proteinase K cocktail/sample and the samples were incubated for 15 minutes.

The Proteinase K solution was then pipetted out.

Samples were washed thoroughly with 10 mM $MgCl_2$ by pipetting up and down the solution during the procedure, and ensuring that all outer parts of the mycelia were being thoroughly washed. The number of washes was tested as each of the following: 1 time, 2 times, 3 times, 4 times, 5 times, 6 times, 7 times, 8 times, 9 times, and 10 times. Optimal washing was determined to be greater than 3 times, and the number of times finalized for use of sample preparation in this Example was 8-10.

Samples were stored in the refrigerator at 4° C. until the genomic DNA extraction of fungi was performed, followed by PCR amplification of the bacterial gene relative to control samples.

Presence or absence of bacteria in the washed fungal samples was verified by PCR using 16S rRNA gene amplification, alongside experimental control samples consisting of: (1) control samples of a known native endofungus that is washed the same way to ensure the washing does not strip away internal bacterium, (2) control samples of a known native endofungus that is untreated, and (3) untreated sample of a known non-complex endophyte fungus (fungus not known to comprise a component bacterium, SYM15890) with about 0.1 mL of pure bacterial culture at log phase added on the surface and washed the same way. PCR results were also compared to that of a control isolated bacterium.

Figure 5:
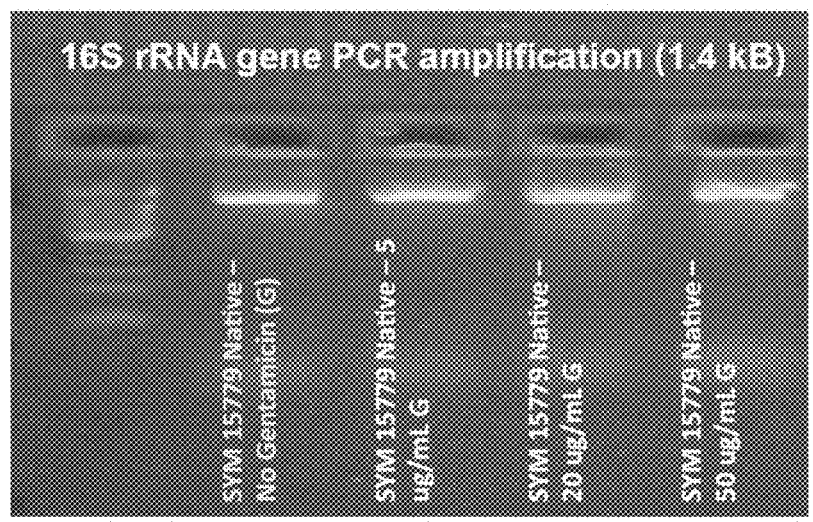
FIG. 5: Bacterial tolerance to antibiotics is improved when bacteria are encapsulated within fungal hosts. Different concentrations of gentamicin between 5 ug/mL gentamicin and 75 ug/mL gentamicin (also see FIG. 6) are equally efficacious at removing surface contaminating bacteria from complex endophytes, while retaining the component endofungal bacteria. Concentrations of 5 ug/mL, 20 ug/mL and 50 ug/mL are equally efficacious at removing surface contaminating bacteria from complex endophytes, while retaining the component endofungal bacteria. Samples were run on 2% agarose gel. Viability of the endofungal bacteria after gentamicin washes was verified by designed complex endophyte culturing and assessing bacterial emergence from the host fungus hyphae.
Figure 6:
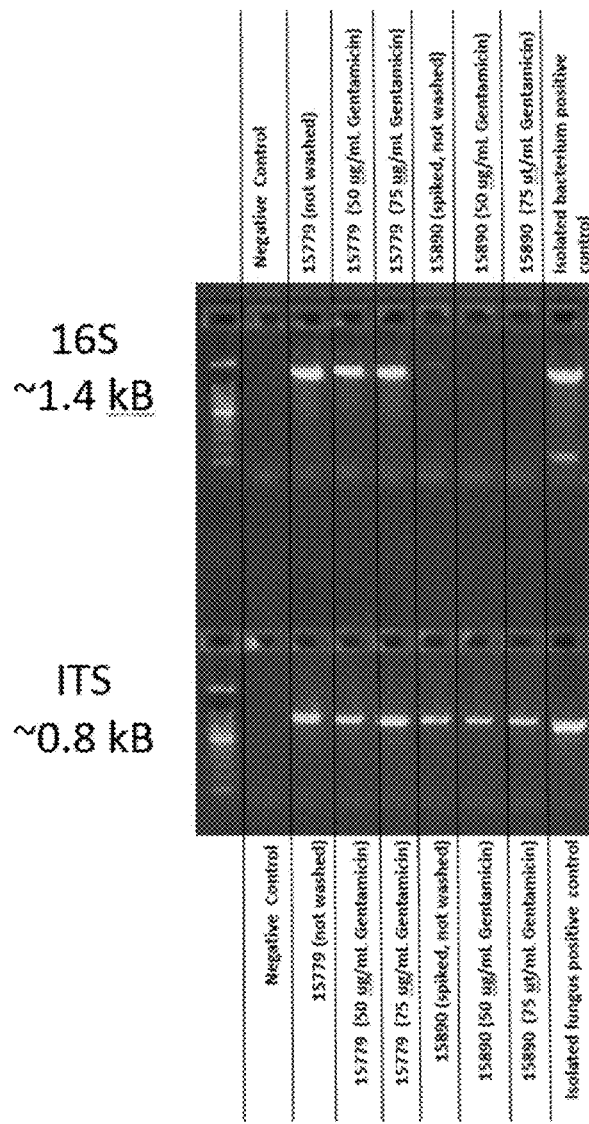
FIG. 6: The process of creating designed complex endophytes is improved by adding a gentamicin wash to the method, to remove contaminating surface bacteria. Endofungal bacterium EHB15779 16S remains detectable in its host fungus SYM15779 even after its host fungus is treated with gentamicin washes. Comparison treatments of SYM15779 not washed (presence of both surface and endofungal bacteria) and washed (presence of endofungal bacteria only) demonstrate presence of bacterial 16S sequence. The non-complex endophyte SYM15890 spiked with a bacterial strain and not washed with gentamicin shows a faint band of bacterial 16S sequence, reflecting the presence of surface bacteria. The non-complex endophyte SYM15890 washed with gentamicin does not show presence of bacterial 16S sequence. Two different concentrations of gentamicin (50 ug/mL and 75 ug/mL) were efficacious. Samples were run on 2% agarose gel.

Results of the method improvement aspect of the invention, demonstrating efficacy of different concentrations of gentamicin for removing surface contaminating bacteria and not affecting the endofungal bacteria, are shown in FIG. 5. FIG. 6 shows that the efficacy of creating designed complex endophytes was improved, due to the removal of surface contaminating bacteria, and thus the only 16S DNA amplification that occurred was due to the presence of endofungal bacteria within the fungal host.

In the second improvement, the range of temperatures of incubation is optimally reduced. Higher temperatures encourage bacterial growth, while lower temperatures reduce bacterial growth to allow fungal cultures to establish and grow. In one alternative protocol, the plates were incubated at a temperature between 18.0° C. and 26.9° C., between 20.0° C. and 26.9° C., between 20.0° C. and 26.0° C., between 20.0° C. and 25.5° C., between 22.0° C. and 25.0° C., and between 23.0° C. and 24.0° C. In one alternative protocol, the plates were incubated between 22.0 and 25.0° C. In one alternative protocol, the plates were incubated between 23.0° C. and 24.0° C. In one alternative protocol, the plates were incubated at 23.5° C.

In the third improvement, the concentration of PDB was reduced to 10% of full strength. Endofungal bacteria will be encouraged to exit their fungal hosts if the environment has sufficient nutrients, and encouranged to remain as endofungal bacteria if the environment has reduced nutrients. In one alternative protocol, the complex endophytes and designed complex endophytes were grown in 0.24% PDB, instead of the full strength 2.4% of the original protocol, with and without the gentamicin treatment and washes described above.

Example 4: Characterization of Designed Complex Endophytes

Designed complex endophytes have unique properties or may produce unique substances that may be beneficial to a plant or to either component in the designed complex endophyte. Even if an endofungal bacterial endophyte has previously been characterized, its introduction into a host fungus may change its behavior, especially by adding novel functions to the symbiotic coupling. The in vitro activities of designed complex endophytes can be tested using the following colorimetric or growth-based assays. Host fungi, endofungal bacterial endophytes, and endofungal fungal endophytes may also be tested using these assays.

Growth on Nitrogen Free LGI Media

All glassware is cleaned with 6M HCl before media preparation. A new 48 well plate (600 microliter well volume) is filled with 500 microliters/well of sterile LGI agar [per L, 50 g Sucrose, 0.01 g FeCl3-6H2O, 0.02 g CaCl2, 0.8 g K3PO4, 0.2 g CaCl2, 0.2 g MgSO4-7H2O, 0.002 g Na2MoO4-2H2O, Agar 15 g, pH 7.5]. Microbes are inoculated into the 48 wells with a flame-sterilized metal loop. The plate is sealed with a breathable membrane, incubated at 28° C. for 3 days, and OD600 readings taken with a 48 well plate reader.

ACC Deaminase Activity

Microbes are assayed for growth with ACC as their sole source of nitrogen. Prior to media preparation all glassware is cleaned with 6 M HCl. A 2 M filter sterilized solution of ACC (#1373A, Research Organics, USA) is prepared in water. 2 microliters/mL of this is added to autoclaved LGI agar (see above), and 500 microliter aliquots are placed in a brand new (clean) 48 well plate. The plate is inoculated with a flame sterilized loop, sealed with a breathable membrane, incubated at 28° C. for 3 days, and OD600 readings taken. Only wells that were significantly more turbid than their corresponding nitrogen free LGI wells are considered to display ACC deaminase activity.

Mineral Phosphate Solubilization

Microbes are plated on tricalcium phosphate media. This is prepared as follows: 10 g/L glucose, 0.373 g/L NH4NO3, 0.41 g/L MgSO4, 0.295 g/L NaCl, 0.003 FeCl3, 0.7 g/L Ca3HPO4, 100 mM Tris and 20 g/L Agar, pH 7, then autoclaved and poured into square Petri plates. After 3 days of growth at 28° C. in darkness, clear halos are measured around colonies that are able to solubilize the tricalcium phosphate.

Acetoin and Diacetyl Production 500 ml of autoclaved R2 broth supplemented with 0.5% glucose are aliquoted into a 48 well plate (#07-200-700, Fisher). Microbes are inoculated using a flame-sterilized metal loop, sealed with a breathable membrane, then incubated for 3 days at 28° C. At day 3, 100 microliters/well is added of freshly blended Barritt's Reagents A and B [5 g/L creatine mixed 3:1 (v/v) with freshly prepared ∝-naphthol (75 g/L in 2.5 M sodium hydroxide)]. After 15 minutes, plates are scored for red or pink colouration relative to a copper coloured negative control (measured as 525 nm absorption on a plate reader).

Auxin Production 500 ml of autoclaved R2 broth supplemented with L-tryptophan to a final concentration of 5 mM are autoclaved and poured into a 48 well plate. Using a flame-sterilized loop, all microbes are inoculated into the plate from a fungal stock. The plate is incubated at 28° C. for 3 days, measured for OD525 and OD600 (to asses fungal growth) and finally, 100 microliters per well of Salkowski reagent (0.01 M ferric chloride in 35% perchloric acid, #311421, Sigma) is added. After 15 minutes, plates were scored for red or pink coloration relative to a clear-colored negative controls (measured as 540 nm absorption on a plate reader).

Siderophore Production

To ensure no contaminating iron is carried over from previous experiments, all glassware is deferrated with 6 M HCl and water prior to media preparation. In this cleaned glassware, R2 broth media, which is iron-limited, is prepared and poured (500 microliters/well) into 48 well plates and the plate then inoculated with fungi using a flame sterilized metal loop. After 3 days of incubation at 28° C., to each well is added 200 microliters of O-CAS preparation without gelling agent. Again using the cleaned glassware, 1 liter of O-CAS overlay is made by mixing 60.5 mg of Chrome azurol S (CAS), 72.9 mg of hexadecyltrimethyl ammonium bromide (HDTMA), 30.24 g of finely crushed Piperazine-1,4-bis-2-ethanesulfonic acid (PIPES) with 10 ml of 1 mM FeCl3.6H2O in 10 mM HCl solvent. The PIPES has to be finely powdered and mixed gently with stirring (not shaking) to avoid producing bubbles, until a dark blue colour is achieved. 15 minutes after adding the reagent to each well, color change is scored by looking for purple halos (catechol type siderophores) or orange colonies (hydroxamate siderophores) relative to the deep blue of the O-Cas.

Antibiosis

Agar plates containing bacteria or yeast in the agar are prepared first by adding fresh overnight cultures of E. coli DH5α or Saccharomyces cerevisiae (yeast) to agar. These are first diluted to OD600=0.2, then 1 microliter/mL of this blended into sterile, cool to the touch, but still liquid R2A agar. These are poured into square Petri dishes, which are then inoculated when solid by using a flame-sterilized metal loop and grown for 3 days at 28° C. At this time, plates are scanned and antibiosis is scored by looking for clear halos around fungal colonies.

Phenotype

Colonies of designed complex endophytes, fungal hosts, and individual component bacteria were plated out on agar and grown for 3 days at 28° C. Plates were photographed and phenotypic characteristics were noted. Liquid cultures of those same endophyties (designed complex, fungal hosts, component bacteria) were also grown in PDB liquid cultures.

Figure 7:
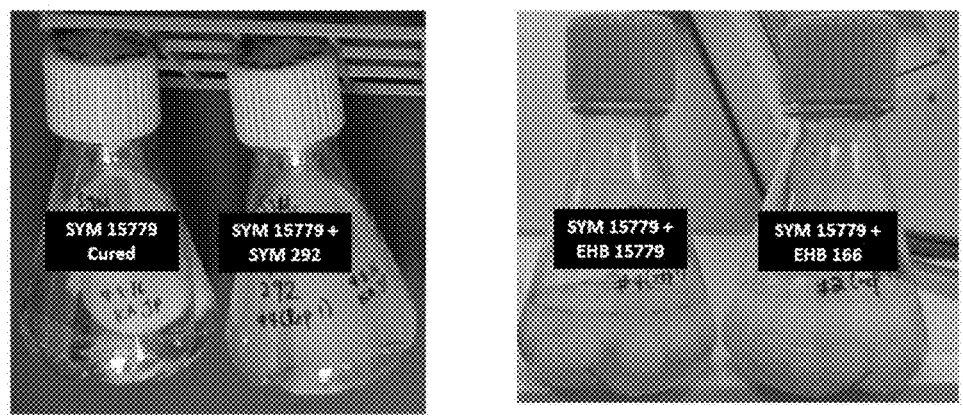
FIG. 7: Liquid culture broths of designed complex endophytes and the cured fungal host. Liquid cultures of designed complex endophytes, each comprising a host fungus and a component bacterium, show distinct morphological differences compared to the cured host fungus. SYM15779 cured host fungus in liquid PDB culture, alongside liquid cultures of the designed complex endophytes 15779+292, 15779+EHB15779, 15779+EHB166.

FIG. 7 shows the liquid culture media for the designed complex endophytes of the present invention, as compared to the cured/empty fungal hosts.

Figure 8A:
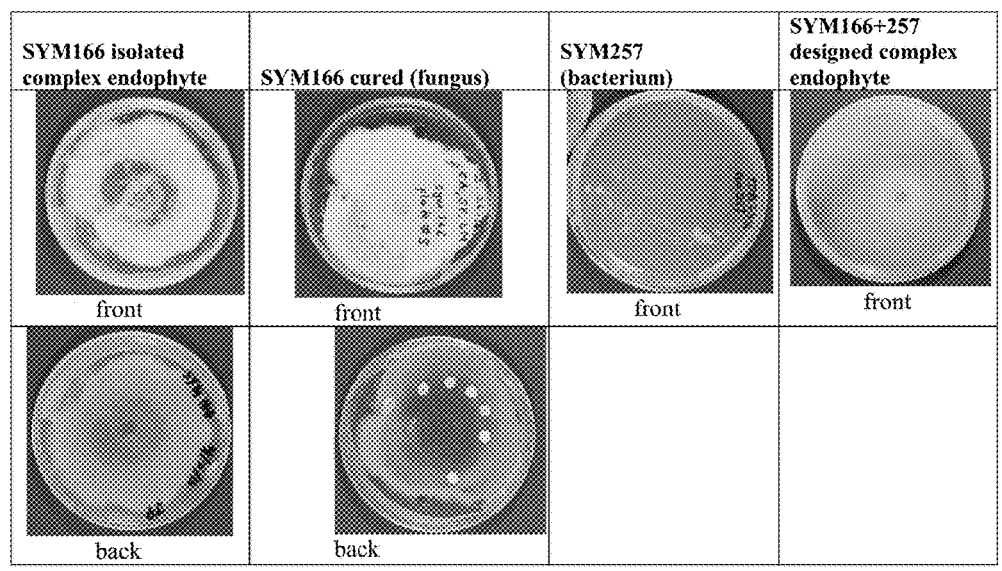
FIG. 8A and FIG. 8B: A designed complex endophyte, its components, and original fungal host source. Culture plates and PCR verification of designed complex endophyte incorporation of the bacterium into the host fungus.
Figure 8B:
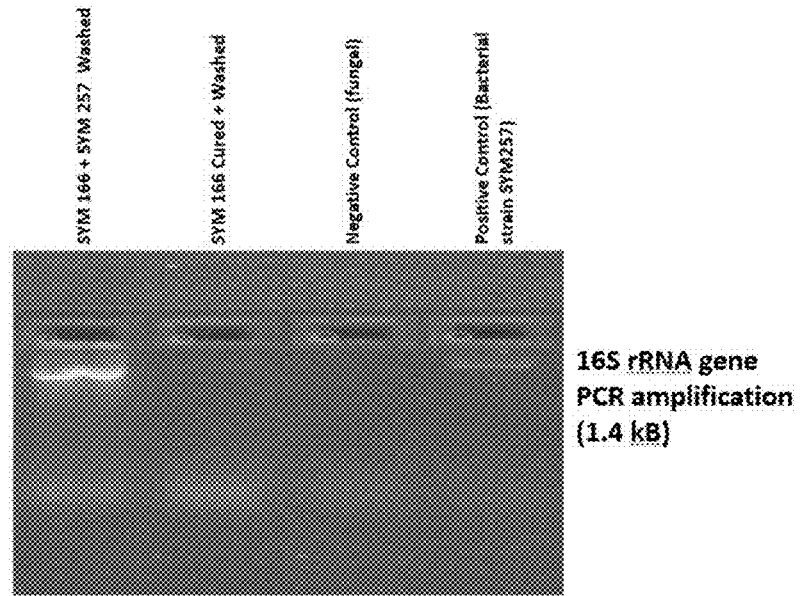

FIG. 8 shows the culture plates for the designed complex endophytes of the present invention, as compared to the cured/empty fungal hosts.

FIG. 9 shows the microscopy images of empty fungal hosts and newly created designed complex endophytes of the present invention.

Example 5: Creation of Designed Complex Endophyte and Plant Element Associations Untreated soy and wheat seeds were surface sterilized using chlorine fumes. Briefly, Erlenmyer flasks containing seeds and a bottle with 100 mL of fresh bleach solution were placed in a desiccation jar located in a fume hood. Immediately prior to closing the lid of the desiccation jar, 3 mL hydrochloric acid was carefully pipetted into the bleach. Sterilization was done for 17 hours for soy and 16 hours for wheat. Upon completion the flasks with seeds were removed, sealed in sterile foil, and opened in a sterile biosafety cabinet or laminar flow hood for subsequent work.

Seeds were coated with endophytes as follows. 2% sodium alginate (SA) was prepared and autoclaved. An Erlenmeyer flask was filled with appropriate amount of deionized water and warmed to about 50 degrees on a heat plate with agitation using stirring bar. SA powder was poured slowly until it all dissolved. The solution was autoclaved at 121° C. @15 PSI for 30 minutes.

Talcum powder was autoclaved in a dry cycle (121° C. @15 PSI for 30 minutes) and aliquoted in Ziploc bags or 50 ml falcon tubes.

Endophyte inocula were prepared in the amounts indicated below. For controls, endophyte powder was substituted with talc, or liquid endophyte with the liquid medium (Yeast Extract Peptone Broth), respectively.

For powder seed treatment, seeds were placed in a large plastic container. 50 mL of the 2% SA was applied per kilogram of seeds to be treated. The container was covered with a hinged lid and shaken slowly in orbital motion for about 20 seconds to disperse the SA. 12.5 g of fungal powder was premixed with 137.5 g of talcum powder, per kg of seed to be treated. A mixture of the endophyte inocula and talc was dispersed evenly on top of the seeds, the container covered, and the seeds shaken slowly in orbital motion for about 20 seconds. Excess powder was sieved off and the seeds packed in paper bags for storage prior to planting.

For liquid seed treatment, seeds were placed in a large plastic container. 25 ml of 2% SA per kg of seed and the same amount of endophyte culture (25 ml per kg of seed) was poured on the seeds. The container was covered with a hinged lid and shaken slowly in orbital motion for about 20 seconds to disperse the SA. 137.5 g of talcum powder per kg of seed was added and dispersed evenly, the container covered, and the seeds shaken slowly in orbital motion for about 20 seconds. Excess formulation was sieved off and the seeds packed in paper bags for storage prior to planting.

It is contemplated that the described method may be utilized to associate a designed complex endophyte, or its fungal host endophyte, or its bacterial endophyte component, with any plant element. Included within the scope of this invention as non-limiting examples of such are methods of associating such endophytes with liquid or powder formulations further comprising a designed complex endophyte, a bacterial endophyte, or a fungal endophyte, with a seed, a root, a tuber, a keikis, a bud, a stem, a leaf, a flower, a bud, a wound on a plant, a stolon, a pistil, a stamen, a root nodule, a shoot, a seedling, a fruit, or a whole plant or portion thereof.

Seed Treatment

A complex, fungal, or bacterial endophyte were inoculated onto seeds as a liquid or powder using a range of formulations including the following components; sodium alginate and/or methyl cellulose as stickers, talc and flowability polymers. Seeds were air dried after treatment and planted according to common practice for each crop type.

Osmopriming and Hydropriming

A complex, fungal, or bacterial endophyte is inoculated onto seeds during the osmopriming (soaking in polyethylene glycol solution to create a range of osmotic potentials) and/or hydropriming (soaking in de-chlorinated water) process. Osmoprimed seeds are soaked in a polyethylene glycol solution containing a bacterial and/or fungal endophyte for one to eight days and then air dried for one to two days. Hydroprimed seeds are soaked in water for one to eight days containing a bacterial and/or fungal endophyte and maintained under constant aeration to maintain a suitable dissolved oxygen content of the suspension until removal and air drying for one to two days. Talc and or flowability polymer are added during the drying process.

Foliar Application

A complex, fungal, or bacterial endophyte is inoculated onto aboveground plant tissue (leaves and stems) as a liquid suspension in dechlorinated water containing adjuvants, sticker-spreaders and UV protectants. The suspension is sprayed onto crops with a boom or other appropriate sprayer.

Soil Inoculation

A complex, fungal, or bacterial endophyte is inoculated onto soils in the form of a liquid suspension either; pre-planting as a soil drench, during planting as an in furrow application, or during crop growth as a side-dress. A fungal or bacterial endophyte is mixed directly into a fertigation system via drip tape, center pivot or other appropriate irrigation system.

Hydroponic and Aeroponic Inoculation

A complex, fungal, or bacterial endophyte is inoculated into a hydroponic or aeroponic system either as a powder or liquid suspension applied directly to the rockwool substrate, or applied to the circulating or sprayed nutrient solution.

Vector-Mediated Inoculation

A complex, fungal, or bacterial endophyte is introduced in power form in a mixture containing talc or other bulking agent to the entrance of a beehive (in the case of bee-mediation) or near the nest of another pollinator (in the case of other insects or birds. The pollinators pick up the powder when exiting the hive and deposit the inoculum directly to the crop's flowers during the pollination process.

Root Wash

The method includes contacting the exterior surface of a plant's roots with a liquid inoculant formulation containing a purified bacterial population, a purified fungal population, a purified designed complex endophyte population, or a mixture of any of the preceding. The plant's roots are briefly passed through standing liquid microbial formulation or liquid formulation is liberally sprayed over the roots, resulting in both physical removal of soil and microbial debris from the plant roots, as well as inoculation with microbes in the formulation.

Seedling Soak

The method includes contacting the exterior surfaces of a seedling with a liquid inoculant formulation containing a purified bacterial population, a purified fungal population, or a mixture of any of the preceding. The entire seedling is immersed in standing liquid microbial formulation for at least 30 seconds, resulting in both physical removal of soil and microbial debris from the plant roots, as well as inoculation of all plant surfaces with microbes in the formulation. Alternatively, the seedling can be germinated from seed in or transplanted into media soaked with the microbe(s) of interest and then allowed to grow in the media, resulting in soaking of the plantlet in microbial formulation for much greater time totaling as much as days or weeks. Endophytic microbes likely need time to colonize and enter the plant, as they explore the plant surface for cracks or wounds to enter, so the longer the soak, the more likely the microbes will successfully be installed in the plant.

Wound Inoculation

The method includes contacting the wounded surface of a plant with a liquid or solid inoculant formulation containing a purified bacterial population, a purified fungal population, or a mixture of any of the preceding. Plant surfaces are designed to block entry of microbes into the endosphere, since pathogens attempting to infect plants in this way. In order to introduce beneficial endophytic microbes to plant endospheres, we need a way to access the interior of the plant which we can do by opening a passage by wounding. This wound can take a number of forms, including pruned roots, pruned branches, puncture wounds in the stem breaching the bark and cortex, puncture wounds in the tap root, puncture wounds in leaves, and puncture wounds seed allowing entry past the seed coat. Wounds can be made using needles, hammer and nails, knives, drills, etc. Into the wound can then be contacted the microbial inoculant as liquid, as powder, inside gelatin capsules, in a pressurized capsule injection system, in a pressurized reservoir and tubing injection system, allowing entry and colonization by microbes into the endosphere. Alternatively, the entire wounded plant can be soaked or washed in the microbial inoculant for at least 30 seconds, giving more microbes a chance to enter the wound, as well as inoculating other plant surfaces with microbes in the formulation—for example pruning seedling roots and soaking them in inoculant before transplanting is a very effective way to introduce endophytes into the plant.

Injection

The method includes injecting microbes into a plant in order to successfully install them in the endosphere. Plant surfaces are designed to block entry of microbes into the endosphere, since pathogens attempting to infect plants in this way. In order to introduce beneficial endophytic microbes to endospheres, we need a way to access the interior of the plant which we can do by puncturing the plant surface with a need and injecting microbes into the inside of the plant. Different parts of the plant can be inoculated this way including the main stem or trunk, branches, tap roots, seminal roots, buttress roots, and even leaves. The injection can be made with a hypodermic needle, a drilled hole injector, or a specialized injection system, and through the puncture wound can then be contacted the microbial inoculant as liquid, as powder, inside gelatin capsules, in a pressurized capsule injection system, in a pressurized reservoir and tubing injection system, allowing entry and colonization by microbes into the endosphere.

Example 6: Verification of Designed Complex Endophyte Colonization in Plant Elements or Whole Plants The following methods may be used to verify stable integration of the designed complex endophyte or endophytic components with the target plant host or target plant host plant elements, as well as verification of presence of the designed complex endophyte or endophytic components that have been transmitted to progeny of the target plant host.
Culturing to Confirm Colonization of Plant by Bacteria The presence of designed complex endophytes in whole plants or plant elements, such as seeds, roots, leaves, or other parts, can be detected by isolating microbes from plant or plant element homogenates (optionally surface-sterilized) on antibiotic-free media and identifying visually by colony morphotype and molecular methods described herein. Representative colony morphotypes are also used in colony PCR and sequencing for isolate identification via ribosomal gene sequence analysis as described herein. These trials are repeated twice per experiment, with 5 biological samples per treatment.
Culture-Independent Methods to Confirm Colonization of the Plant or Seeds by Designed Complex Endophytes One way to detect the presence of designed complex endophytes on or within plants or seeds is to use quantitative PCR (qPCR). Internal colonization by the designed complex endophyte can be demonstrated by using surface-sterilized plant tissue (including seed) to extract total DNA, and isolate-specific fluorescent MGB probes and amplification primers are used in a qPCR reaction. An increase in the product targeted by the reporter probe at each PCR cycle therefore causes a proportional increase in fluorescence due to the breakdown of the probe and release of the reporter. Fluorescence is measured by a quantitative PCR instrument and compared to a standard curve to estimate the number of fungal or bacterial cells within the plant.

The design of both species-specific amplification primers, and isolate-specific fluorescent probes are well known in the art. Plant tissues (seeds, stems, leaves, flowers, etc.) are pre-rinsed and surface sterilized using the methods described herein.

Total DNA is extracted using methods known in the art, for example using commercially available Plant-DNA extraction kits, or the following method.

1. Tissue is placed in a cold-resistant container and 10-50 mL of liquid nitrogen is applied. Tissues are then macerated to a powder.

2. Genomic DNA is extracted from each tissue preparation, following a chloroform:isoamyl alcohol 24:1 protocol (Sambrook, Joseph, Edward F. Fritsch, and Thomas Maniatis. Molecular cloning. Vol. 2. New York: Cold spring harbor laboratory press, 1989).

Quantitative PCR is performed essentially as described by Gao, Zhan, et al. Journal of clinical microbiology 48.10 (2010): 3575-3581 with primers and probe(s) specific to the desired isolate (the host fungus, the endofungal bacterial endophyte, or the endofungal fungal endophyte) using a quantitative PCR instrument, and a standard curve is constructed by using serial dilutions of cloned PCR products corresponding to the specie-specific PCR amplicon produced by the amplification primers. Data are analyzed using instructions from the quantitative PCR instrument's manufacturer software.

As an alternative to qPCR, Terminal Restriction Fragment Length Polymorphism, (TRFLP) can be performed, essentially as described in Johnston-Monje D, Raizada M N (2011) PLoS ONE 6(6): e20396. Group specific, fluorescently labeled primers are used to amplify a subset of the microbial population, for example bacteria and fungi. This fluorescently labeled PCR product is cut by a restriction enzyme chosen for heterogeneous distribution in the PCR product population. The enzyme cut mixture of fluorescently labeled and unlabeled DNA fragments is then submitted for sequence analysis on a Sanger sequence platform such as the Applied Biosystems 3730 DNA Analyzer.
Immunological Methods to Detect Designed Complex Endophytes in Seeds and Vegetative Tissues A polyclonal antibody is raised against specific the host fungus, the endofungal bacterial endophyte, or the endofungal fungal endophyte via standard methods. Enzyme-linked immunosorbent assay (ELISA) and immunogold labeling is also conducted via standard methods, briefly outlined below.

Immunofluorescence microscopy procedures involve the use of semi-thin sections of seed or seedling or adult plant tissues transferred to glass objective slides and incubated with blocking buffer (20 mM Tris (hydroxymethyl)-aminomethane hydrochloride (TBS) plus 2% bovine serum albumin, pH 7.4) for 30 min at room temperature. Sections are first coated for 30 min with a solution of primary antibodies and then with a solution of secondary antibodies (goat anti-rabbit antibodies) coupled with fluorescein isothiocyanate (FITC) for 30 min at room temperature. Samples are then kept in the dark to eliminate breakdown of the light-sensitive FITC. After two 5-min washings with sterile potassium phosphate buffer (PB) (pH 7.0) and one with double-distilled water, sections are sealed with mounting buffer (100 mL 0.1 M sodium phosphate buffer (pH 7.6) plus 50 mL double-distilled glycerine) and observed under a light microscope equipped with ultraviolet light and a FITC Texas-red filter.

Ultrathin (50- to 70-nm) sections for TEM microscopy are collected on pioloform-coated nickel grids and are labeled with 15-nm gold-labeled goat anti-rabbit antibody. After being washed, the slides are incubated for 1 h in a 1:50 dilution of 5-nm gold-labeled goat anti-rabbit antibody in IGL buffer. The gold labeling is then visualized for light microscopy using a BioCell silver enhancement kit. Toluidine blue (0.01%) is used to lightly counterstain the gold-labeled sections. In parallel with the sections used for immunogold silver enhancement, serial sections are collected on uncoated slides and stained with 1% toluidine blue. The sections for light microscopy are viewed under an optical microscope, and the ultrathin sections are viewed by TEM.

Example 7: Demonstration of Phenotypic Alterations of Host Plants Due to Presence of the Designed Complex Endophyte: Germination Assays Testing for Germination Enhancement in Normal Conditions Standard germination tests are used to assess the ability of the designed complex endophyte to enhance the seeds' germination and early growth. Briefly, seeds that have been coated with the designed complex endophyte or bacterial endophyte component as described elsewhere are placed in between wet brown paper towels. An equal number of seeds obtained from control plants that do not contain the endophyte (complex or fungal or bacterial) are treated in the same way. The paper towels re placed on top of 1×2 feet plastic trays and maintained in a growth chamber set at 25° C. and 70% humidity for 7 days. The proportion of seeds that germinated successfully is compared between the designed complex endophyte-treated seeds and the non-designed complex endophyte-treated.

Testing for Germination Enhancement Under Biotic Stress

A modification of the method developed by Hodgson [Am. Potato. J. 38: 259-264 (1961)] is used to test germination enhancement in designed complex endophyte-treated seeds under biotic stress. Biotic stress is understood as a concentration of inocula in the form of cell (bacteria) or spore suspensions (fungus) of a known pathogen for a particular crop (e.g., *Pantoea stewartii* or *Fusarium graminearum* for *Zea mays* L.). Briefly, for each level of biotic stress, seeds that have been treated with designed complex endophyte strains, and seed controls (lacking the designed complex endophyte strains), are placed in between brown paper towels. Each one of the replicates is placed inside a large petri dish (150 mm in diameter). The towels are then soaked with 10 mL of pathogen cell or spore suspension at a concentration of $10^4$ to $10^8$ cells/spores per mL. Each level corresponds with an order of magnitude increment in concentration (thus, 5 levels). The petri dishes are maintained in a growth chamber set at 25° C. and 70% humidity for 7 days. The proportion of seeds that germinate successfully is compared between the designed complex endophyte-treated seeds and the non-designed complex endophyte-treated for each level of biotic stress.

Testing for Germination Enhancement Under Drought Stress

Polyethylene glycol (PEG) is an inert, water-binding polymer with a non-ionic and virtually impermeable long chain [Couper and Eley, J. Polymer Sci., 3: 345-349 (1984)] that accurately mimics drought stress under dry-soil conditions. The higher the concentration of PEG, the lower the water potential achieved, thus inducing higher water stress in a watery medium. To determine germination enhancement in seeds treated with designed complex endophytes or bacterial endophyte components, the effect of osmotic potential on germination is tested at a range of water potential representative of drought conditions following Perez-Fernandez et al. [J. Environ. Biol. 27: 669-685 (2006)]. The range of water potentials simulated those that are known to cause drought stress in a range of cultivars and wild plants, (−0.05 MPa to −5 MPa) [Craine et al., Nature Climate Change 3: 63-67 (2013)]. The appropriate concentration of polyethylene glycol (6000) required to achieve a particular water potential is determined following Michel and Kaufmann (Plant Physiol., 51: 914-916 (1973)) and further modifications by Hardegree and Emmerich (Plant Physiol., 92, 462-466 (1990)). The final equation used to determine amounts of PEG is: $\Psi = 0.130 [PEG]^2 T - 13.7 [PEG]^2$; where the osmotic potential ($\Psi$) is a function of temperature (T). Germination experiments are conducted in 90 mm diameter petri dishes. Replicates consisted of a Petri dish, watered with 10 mL of the appropriate solution and 20 seeds floating in the solution. The experiment contains seeds treated with the designed complex endophyte, in addition to seed controls (lacking the microbial strains). To prevent large variations in $\Psi$, dishes are sealed with parafilm and the PEG solutions are renewed weekly by pouring out the existing PEG in the petri dish and adding the same amount of fresh solution. Petri dishes are maintained in a growth chamber set at 25° C., 16:8 hour light:dark cycle, 70% humidity, and least 120 microE/m^2/s light intensity. The proportion of seeds that germinated successfully after three days (wheat) or five days (soybean) is compared between the endophyte-treated seeds (complex and bacterial) and the non-endophyte-treated.

Testing for Germination Enhancement in Heat Conditions

Standard germination tests are used to determine if a designed complex endophyte protects a seedling or plant against heat stress during germination. Briefly, seeds treated with designed complex endophytes are placed in between wet brown paper towels. An equal number of seeds obtained from control plants that lack the designed complex endophyte is treated in the same way. The paper towels are placed on top of 1×2 ft plastic trays and maintained in a growth chamber set at 16:8 hour light:dark cycle, 70% humidity, and at least 120 microE/m^2/s light intensity for 7 days. A range of high temperatures (from 35° C. to 45° C., with increments of 2 degrees per assay) is tested to assess the germination of designed complex endophyte-treated seeds at each temperature. The proportion of seeds that germinate successfully is compared between the designed complex endophyte-treated seeds and the non-designed complex endophyte-treated.

Testing for Germination Enhancement in Cold Conditions

Standard germination tests are used to determine if a designed complex endophyte protects a seedling or plant against cold stress during germination. Briefly, seeds treated with designed complex endophytes are placed in between wet brown paper towels. An equal number of seeds obtained from control plants that lack the designed complex endophyte is treated in the same way. The paper towels are placed on top of 1×2 ft plastic trays and maintained in a growth chamber set at 16:8 hour light:dark cycle, 70% humidity, and at least 120 microE/m^2/s light intensity for 7 days. A range of low temperatures (from 0° C. to 10° C., with increments of 2 degrees per assay) is tested to assess the germination of designed complex endophyte-treated seeds at each temperature. The proportion of seeds that germinate successfully is compared between the designed complex endophyte-treated seeds and the non-designed complex endophyte-treated.

Testing for Germination Enhancement in High Salt Concentrations

Germination experiments are conducted in 90 mm diameter petri dishes. Replicates consist of a Petri dish, watered with 10 mL of the appropriate solution and 20 seeds floating in the solution. Seeds treated with designed complex endophytes and seed controls (lacking the microbial strains) are tested in this way. To prevent large variations in salt concentration due to evaporation, dishes are sealed with parafilm and the saline solutions are renewed weekly by pouring out the existing saline solution in the petri dish and adding the same amount of fresh solution. A range of saline solutions (100-500 mM NaCl) is tested for to assess the germination of designed complex endophyte-treated seeds at varying salt levels. Petri dishes are maintained in a growth chamber set at 25° C., 16:8 hour light:dark cycle, 70% humidity, and at least 120 microE/m^2/s light intensity. The proportion of seeds that germinates successfully after two weeks is compared between the designed complex endophyte-treated seeds and the non-designed complex endophyte-treated.

Testing for Germination Enhancement in Soils with High Metal Content

Standard germination tests are used to determine if a designed complex endophyte protects a seedling or plant against stress due to high soil metal content during germination. Briefly, seeds treated with designed complex endophytes, are placed in between wet brown paper towels. An equal number of seeds obtained from control plants that lack the designed complex endophyte (designed complex endophyte-free) is treated in the same way. The paper towels are placed on top of 1×2 ft plastic trays with holes to allow water drainage. The paper towels are covered with an inch of sterile sand. For each metal to be tested, the sand needs to be treated appropriately to ensure the release and bioavailability of the metal. For example, in the case of aluminum, the sand is watered with pH 4.0+~1 g/Kg soil Al+3 (~621 microM). The trays are maintained in a growth chamber set at 25° C. and 70% humidity for 7 days. The proportion of seeds that germinates successfully is compared between the designed complex endophyte-treated seeds and the non-designed complex endophyte-treated.

Example 8: Demonstration of Phenotypic Alterations of Host Plants Due to Presence of the Designed Complex Endophyte: Growth Chamber Assays Testing for Growth Promotion in Growth Chamber in Normal Conditions Soil is made from a mixture of 60% Sunshine Mix #5 (Sun Gro; Bellevue, Wash., USA) and 40% vermiculite. To determine if a particular designed complex endophyte is capable of promoting plant growth under normal conditions, pots are prepared in 12-pot no-hole flat trays with 28 grams of dry soil in each pot, and 2 L of filtered water is added to each tray. The water is allowed to soak into the soil and the soil surface is misted before seeding. For each seed-designed complex endophyte combination, some pots are seeded with 3-5 seeds treated with the designed complex endophyte and other pots are seeded with 3-5 seeds lacking the designed complex endophyte (designed complex endophyte-free plants). The seeded pots are covered with a humidity dome and kept in the dark for 3 days, after which the pots are transferred to a growth chamber set at 25° C., 16:8 hour light:dark cycle, 70% humidity, and at least 120 microE/m^2/s light intensity. The humidity domes are removed on day 5, or when cotyledons are fully expanded. After removal of the domes, each pot is irrigated to saturation with 0.5× Hoagland's solution, then allowing the excess solution to drain. Seedlings are then thinned to 1 per pot. In the following days, the pots are irrigated to saturation with filtered water, allowing the excess water to drain after about 30 minutes of soaking, and the weight of each 12-pot flat tray is recorded weekly. Canopy area is measured at weekly intervals. Terminal plant height, average leaf area and average leaf length are measured at the end of the flowering stage. The plants are allowed to dry and seed weight is measured. Significance of difference in growth between designed complex endophyte-treated plants and controls lacking the designed complex endophyte is assessed with the appropriate statistical test depending on the distribution of the data at $p<0.05$.

Testing for Growth Promotion in Growth Chamber Under Biotic Stress

Soil is made from a mixture of 60% Sunshine Mix #5 (Sun Gro; Bellevue, Wash., USA) and 40% vermiculite. To determine if a particular designed complex endophyte is capable of promoting plant growth in the presence of biotic stress, pots are prepared in 12-pot no-hole flat trays with 28 grams of dry soil in each pot, and 2 L of filtered water is added to each tray. The water is allowed to soak into the soil before planting. For each seed-designed complex endophyte combination test, some pots are seeded with 3-5 seeds treated with the designed complex endophyte and other pots are seeded with 3-5 seeds lacking the designed complex endophyte (designed complex endophyte-free plants). The seeded pots are covered with a humidity dome and kept in the dark for 3 days, after which the pots are transferred to a growth chamber set at 25° C., 16:8 hour light:dark cycle, 70% humidity, and at least 120 μE/m2/s light intensity. The humidity domes are removed on day 5, or when cotyledons are fully expanded. After removal of the domes, each pot is irrigated to saturation with 0.5× Hoagland's solution, allowing the excess solution to drain. Seedlings are then thinned to 1 per pot. In the following days, the pots are irrigated to saturation with filtered water, allowing the excess water to drain after about 30 minutes of soaking.

Several methods of inoculation are used depending on the lifestyle of the pathogen. For leaf pathogens (e.g., *Pseudomonas syringeae* or *Colletotrichum graminicola*), a suspension of cells for bacteria ($10^8$ cell/mL) or spores for fungi ($10^7$ spores/mL) is applied with an applicator on the adaxial surface of each of the youngest fully expanded leaves. Alternatively for fungal pathogens that do not form conidia easily, two agar plugs containing mycelium (~4 mm in diameter) are attached to the adaxial surface of each of the youngest leaves on each side of the central vein. For vascular pathogens (e.g., *Pantoea stewartii* or *Fusarium moniliforme*), the suspension of cells or spores is directly introduced into the vasculature (5-10 microLiters) through a minor injury inflected with a sterile blade. Alternatively, the seedlings can be grown hydroponically in the cell/spore or mycelium suspension. To test the resilience of the plant-designed complex endophyte combination against insect stresses, such as thrips or aphids, plants are transferred to a specially-designated growth chamber containing the insects. Soil-borne insect or nematode pathogens are mixed into or applied topically to the potting soil. In all cases, care is taken to contain the fungal, insect, nematode or other pathogen and prevent release outside of the immediate testing area.

The weight of each 12-pot flat tray is recorded weekly. Canopy area is measured at weekly intervals. Terminal plant height, average leaf area and average leaf length are measured at the cease of flowering. The plants are allowed to dry and seed weight is measured. Significance of difference in growth between designed complex endophyte-treated plants and controls lacking the designed complex endophyte is assessed with the appropriate statistical test depending on the distribution of the data at $p<0.05$.

Example 9: Demonstration of Phenotypic Alterations of Host Plants Due to Presence of the Designed Complex Endophyte: Plant Vigor Seedling Assays Untreated soybean and winter wheat seeds were surface sterilized using chlorine fumes. Briefly, Erlenmyer flasks containing seeds and a bottle with 100 mL of fresh bleach solution were placed in a desiccation jar located in a fume hood. Immediately prior to closing the lid of the desiccation jar, 3 mL hydrochloric acid was carefully pipetted into the bleach. Sterilization was done for 17 hours for soy and 16 hours for wheat. Upon completion the flasks with seeds were removed, sealed in sterile foil, and opened in a sterile biosafety cabinet or laminar flow hood for subsequent work.

Designer endofungal endophytes, cured fungal hosts, and bacteria used for co-culture were grown in Erlenmeyer flasks containing 150 mL potato dextrose broth (PDB) at 25°

C. with constant agitation (130 RPM) for 13 days, and 4 days respectively. Samples that grew in culture as balls of mycelial biomass were briefly sonicated to obtain a homogenous suspension of culture. Surface sterilized soy and wheat seeds were first coated with 2% sodium alginate to enable microbial adhesion, and then treated with equal volume of microbial culture in a 50 mL Falcon tube. Seeds were mixed for homogenous coating. Seed treatment calculations were based on 0.01 mL each of microbial culture and 2% sodium alginate solution for every one gram of seed.

Twelve soy and wheat treated seeds were placed equidistant to each other on heavy weight germination paper saturated with 30 mL of sterile distilled water. Another sheet of germination paper saturated with 20 mL of water was placed on top of the seeds. Seed samples were placed inside square Petri plates measuring 22.4×22.4 cm wide. Lids of the square Petri plates were sealed and plates were placed inside two boxes for each crop. All steps were performed under sterile conditions.

All samples were incubated at 24° Celsius with 65% relative humidity in darkness for 3 days to enable seed germination. On day 3, the top germination paper sheet covering the seedlings was removed and the lids slightly opened to allow for gradual water stress. The chamber setting was changed to 24° Celsius, 60% relative humidity, 250-300 microEinsten light for 12 hours followed by 18° Celsius, 50% relative humidity for 12 hours of darkness for 4 days for wheat and 5 days for soy. The top sheets of germination paper and lids for the second set of seedlings for both crops remained intact to maintain plant growth in a non-water stress condition. Placement of plates within each box was randomized periodically to reduce any positional effect throughout the plant growth period. At the end of the experiment, each seedling was photographed and measured for total root surface area and mass. All rounds of assays included non-treated seed samples to ensure seed viability. Raw data number averages of each treatment were obtained by computing mean, standard deviation and standard error for all germinated seedlings per replicate. Seedlings that failed to germinate or displayed phenotypic abnormalities were excluded from analysis. Analyses were performed for each designed complex endohyte-treated sample relative to the corresponding bacterium-treated sample.

Results of Wheat Seedling Normal Conditions are shown in Table 4. Results of Wheat Seedling Drought (Water-Stressed) Conditions are shown in Table 5. Results of Soy Seedling Normal Conditions are shown in Table 6.

Table 7 shows the aggregated results of the plant vigor assays, highlighting the benefits of the designed complex endophytes vs. their component fungi and bacteria. Each complex endophyte may, as demonstrated in other examples, may impart additional benefits to the plant, or display benefits versus either the fungal component or the bacterial component or both, than the benefits observed in wheat and soybean seedling assays.

In nearly every case, the designed complex endophyte provides a benefit to the seedling for at least one parameter, as compared to at least one of the components alone (bacterium or fungus), and sometimes both. In some cases, the bacterium helps the host fungus become a better endophyte. In some cases, the host fungus helps the component bacterium become a better endophyte. Each of these improvements is demonstrated in both a monocot crop (wheat), a dicot crop (soybean); and further demonstrated under two conditions typically experienced by plants (normal watering conditions and water-limited conditions).

Example 10: Demonstration of Phenotypic Alterations of Host Plants Due to Presence of the Designed Complex Endophyte: Greenhouse Assessments Seeds are coated with designed complex endophytes and isolated bacterial endophytes as follows. 2% sodium alginate (SA) was prepared and autoclaved. An Erlenmeyer flask is filled with appropriate amount of deionized water and warmed to about 50 degrees on a heat plate with agitation using stirring bar. SA powder is poured slowly until it all dissolved. The solution is autoclaved at 121° C. @15 PSI for 30 minutes.

Talcum powder is autoclaved in a dry cycle (121° C. @15 PSI for 30 minutes) and aliquoted in Ziploc bags or 50 ml falcon tubes.

Microbial (designed complex endophyte or fungal endophyte) inocula are prepared in the amounts indicated below. For controls, fungal powder is substituted with talc, or liquid fungus with the liquid medium (Yeast Extract Peptone Broth), respectively.

For wheat fungal powder seed treatment, seeds are placed in a large plastic container. 50 mL of the 2% SA was applied per kilogram of seeds to be treated. The container is covered with a hinged lid and shaken slowly in orbital motion for about 20 seconds to disperse the SA. 12.5 g of fungal powder is with 137.5 g of talcum powder, per kg of seed to be treated. A mixture of the fungal inocula and talc is dispersed evenly on top of the seeds, the container covered, and the seeds shaken slowly in orbital motion for about 20 seconds. Excess powder is sieved off and the seeds packed in paper bags for storage prior to planting.

For wheat fungal liquid seed treatment, seeds are placed in a large plastic container. 25 ml of 2% SA per kg of seed and the same amount of fungal culture (25 ml per kg of seed) is poured on the seeds. The container is covered with a hinged lid and shaken slowly in orbital motion for about 20 seconds to disperse the SA. 137.5 g of talcum powder per kg of seed is added and dispersed evenly, the container covered, and the seeds shaken slowly in orbital motion for about 20 seconds. Excess formulation is sieved off and the seeds packed in paper bags for storage prior to planting.

For each treatment, a standard greenhouse flat divided into 8 compartments with a standard 801 insert is filled with Fafard blend soil (900 mL per compartment) and allowed to soak in 2 L water to provide normal soil moisture conditions. Twelve seeds are planted in each compartment at a consistent depth of 2 cm. Pots are watered approximately 2-4 hours prior to planting seeds. The number of seeds planted per pot depends on the type of crop. For example, three seeds can be planted for soy, four for wheat, and one for corn. Plants are grown at a 21° C./18° C. day/night regime with a 14 hour photoperiod at a light intensity of 800 microE/m^2/s and 40% relative humidity.

Drought experiments are performed as described in the art. For example, water is withheld until the plants start wilting, are watered again, then allowed to enter into another drought cycle. The drought cycles are continued until the plant reached maturity.

Emergence of germinated seeds is observed from days 3 to 8 after planting. Seedlings are harvested at day 8 after planting and dried overnight in a convection oven to collect dry weight and height of each seedling's aerial parts.

Example 11: Demonstration of Phenotypic Alterations of Host Plants Due to Presence of the Designed Complex Endophyte: Field Trials Untreated seed is coated with a specific formulation depending on the type of strain, and a formulation control lacking the endophyte was included for each type of formulation. For strains formulated as dry powders (e.g., SYM166, a.k.a. SYM16670; e.g., fungal endophytes that are not known to be complex endophytes as controls), 2% sodium alginate (16.6 mL per kg seed) is applied and the seeds were agitated for 20 s to disperse the sticker. Then a 1:1 mixture of powder and talc (15 g fungal powder per kg seed) is applied and the seeds are agitated for 20 s to disperse the powder. Then FloRite (13.1 mL per kg seed) is applied and seeds were agitated for 20 s to disperse the flowability polymer.

Treated seeds are placed in paper bags and allowed to dry overnight in a well ventilated space before planting.

All fields (2% slopes) are fallow for the previous season, treated with glyphosate pre-planting and managed with conventional tillage. Untreated, formulation-treated and designed complex endophyte-treated seeds are drilled in with a plot planter in a randomized complete block design in plots, planting densities, and seeding rates typical for the crop. Interior rows are harvested for yield assessment with the outer rows used as a buffer between plots. Grain yield (lb per plot), test weight (lb per bushel) and moisture (%) is taken directly on the combine. Yield dry bushels per acre is calculated using per plot test weights and normalized for a grain storage moisture of 13%. Thousand kernel seed weight (TKW g) is established per plot.

Early and mid-season metrics are collected. Emergence counts are taken over 10 feet on two interior rows at a timepoint when the control plots reach 50% emergence and this area is marked for the harvestable head count at the end of the season. A visual assessment of seedling vigor (1-10 rating scale) is taken at emergence. Tillers are counted on 5 individual plants at 30 days after seeding (DAS) both pre- and post-vernalization. A phytotoxicity visual assessment (%) is taken on the same plants used for tiller counts. Directly prior to harvest, harvestable heads are quantified over a square yard.

Yield (wet and dry, per acre) results for plants grown under dryland (non-irrigated) conditions from seeds associated with a designer designed complex endophyte are calculated, and compared to isoline plants grown from seeds not associated with a designer designed complex endophyte. Plants grown from seeds treated with a designer designed complex endophyte demonstrate improved yield (either wet bushels per acre or dry bushels per acre or both) compared to isoline plants not grown from seeds associated with a designer designed complex endophyte or compared to plants grown from seeds treated with a formulation control.

Example 12: Demonstration of Improved Designed Complex Endophyte Viability on Plant Elements This example describes the methods and results for demonstrating that bacteria encompassed within a host fungus display greater survivability on treated seeds than does the identical bacterial strain isolated and treated on seeds.

Biomass for each of the designed complex endophyte and endophytic components were prepared for seed treatment, as described below. SYM15779 (cured) was a gelatinous culture and thus prepared as a liquid formulation for seed treatment. Designed complex endophytes SYM15779+292 and SYM15779+EHB15779 were dried for preparation as a fungal powder formulation for seed treatment. SYM15890 (cured) and its corresponding designed complex endophytes SYM15890+EHB166 and SYM15890+292 were dried for preparation as a fungal powder formulation for seed treatment. Photographs of the biomass preparations are shown in FIG. 10.

Surface sterilized corn seeds were either coated with liquid formulation as described previously, or using fungal powder harvested by culture filtration followed by overnight drying in a biosafety cabinet and subsequent grinding in a mill. Seeds were first coated with 2% sodium alginate to enable microbial adhesion, and then treated with fungal powder mixed with talc in a 50 mL Falcon tube. Seeds were mixed for homogenous coating. Seed treatment calculations were based on 10 grams each of fungal powder and talc added to 45 mL 2% sodium alginate solution for every one kilogram of seed. All steps were performed under sterile conditions.

Colony Forming Unit (CFU) counts for seeds coated with designer endofungal endophytes, cured fungal hosts, and bacteria used for co-culture were estimated by placing individual seeds in 1 mL of distilled sterile water within a microfuge tube followed by followed by vortexing for 30 seconds and collecting the supernatant. The supernatant was subsequently used to make serial dilutions ($10^{-0}$, $10^{-1}$, $10^{-2}$ and $10^{-3}$) and 0.005 mL of each dilution was plated on LB agar supplemented with cycloheximide. All steps were performed under sterile conditions.

Figure 11A:
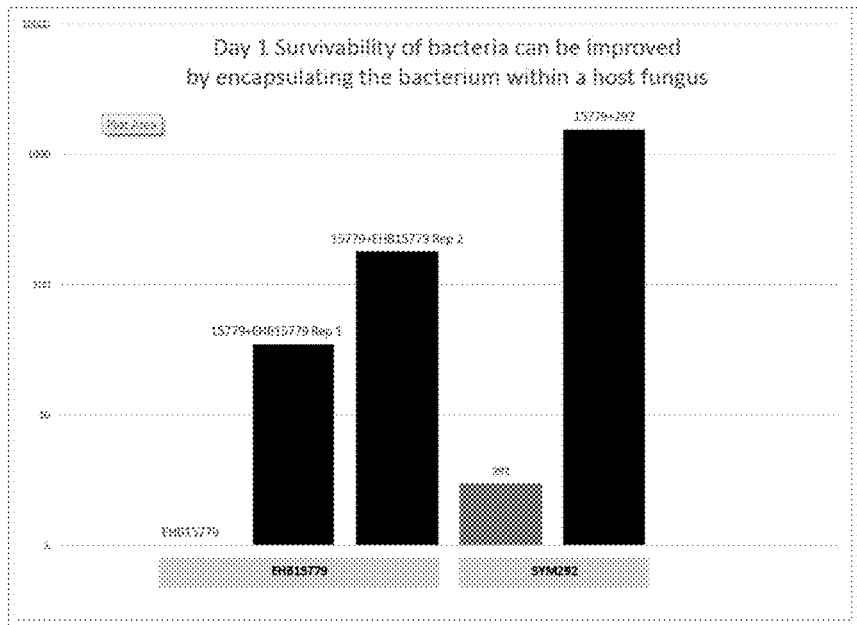
FIG. 11A and FIG. 11B: Survivability of bacteria on plant elements can be improved by encapsulating bacteria within host fungi.
Figure 11B:
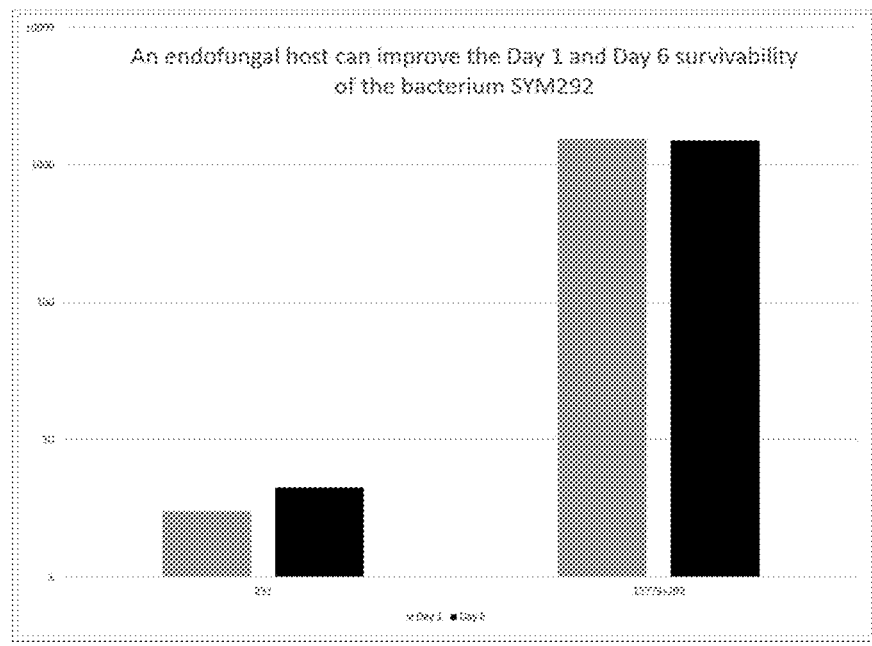

All results are summarized in FIG. 11. As demonstrated in FIG. 11A, Day 1 Survivability of bacteria was improved by encapsulating the bacterium within a host fungus. EHB15779 Day 1 survivability was improved by 1-2 logs by encapsulating within host fungus SYM15779 (2 different reps were performed). SYM292 Day 1 survivability was improved by at least 2.5 logs by encapsulating within SYM15779 (but not SYM15890). As demonstrated in FIG. 11B, an endofungal host improved the Day 1 and Day 6 survivability of a bacterium. The survivability of bacterium SYM292 was improved on both Day 1 and Day 6 by encapsulating it within the host fungus SYM1579. The Day 6 survivability of SYM292 in host fungus SYM25890 was greater on Day 6 than on Day 1.

While the invention has been particularly shown and described with reference to a preferred embodiment and various alternate embodiments, it will be understood by persons skilled in the relevant art that various changes in form and details can be made therein without departing from the spirit and scope of the invention.

All references, issued patents and patent applications cited within the body of the instant specification are hereby incorporated by reference in their entirety, for all purposes.

TABLE 1

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 1 | Bacteria | Firmicutes | Bacilli | Bacillales | Bacillaceae | *Bacillus* |
| 2 | Bacteria | Firmicutes | Bacilli | Bacillales | Bacillaceae | *Bacillus* |
| 3 | Bacteria | Firmicutes | Bacilli | Bacillales | Bacillaceae | *Bacillus* |

TABLE 1-continued

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 4 | Bacteria | Firmicutes | Bacilli | Bacillales | Paenibacillaceae | *Paenibacillus* |
| 5 | Bacteria | Firmicutes | Bacilli | Bacillales | Paenibacillaceae | *Paenibacillus* |
| 6 | Bacteria | Proteobacteria | Gammaproteobacteria | Pseudomonadales | Moraxellaceae | *Acinetobacter* |
| 7 | Bacteria | Proteobacteria | Betaproteobacteria | Burkholderiales | Burkholderiaceae | *Burkholderia* |
| 8 | Bacteria | Proteobacteria | Alphaproteobacteria | Sphingomonadales | Sphingomonadaceae | *Sphingomonas* |
| 9 | Bacteria | Proteobacteria | Gammaproteobacteria | Xanthomonadales | Xanthomonadaceae | *Luteibacter* |
| 10 | Bacteria | Proteobacteria | Alphaproteobacteria | Sphingomonadales | Sphingomonadaceae | *Sphingomonas* |
| 11 | Bacteria | Firmicutes | Bacilli | Bacillales | Paenibacillaceae | *Paenibacillus* |
| 12 | Bacteria | Firmicutes | Bacilli | Bacillales | Paenibacillaceae | *Paenibacillus* |
| 13 | Bacteria | Firmicutes | Bacilli | Bacillales | Paenibacillaceae | *Paenibacillus* |
| 14 | Bacteria | Proteobacteria | Betaproteobacteria | Burkholderiales | Burkholderiaceae | *Ralstonia* |
| 15 | Bacteria | Firmicutes | Bacilli | Bacillales | Bacillaceae | *Bacillus* |
| 16 | Bacteria | Proteobacteria | Betaproteobacteria | Burkholderiales | Burkholderiaceae | *Ralstonia* |
| 17 | Bacteria | Firmicutes | Bacilli | Bacillales | Paenibacillaceae | *Paenibacillus* |
| 18 | Bacteria | Firmicutes | Bacilli | Bacillales | Paenibacillaceae | *Paenibacillus* |
| 19 | Bacteria | Firmicutes | Bacilli | Bacillales | Paenibacillaceae | *Paenibacillus* |
| 20 | Bacteria | Firmicutes | Bacilli | Bacillales | Bacillaceae | *Bacillus* |
| 21 | Bacteria | Firmicutes | Bacilli | Bacillales | Paenibacillaceae | *Paenibacillus* |
| 22 | Bacteria | Firmicutes | Bacilli | Bacillales | Paenibacillaceae | *Paenibacillus* |
| 23 | Bacteria | Firmicutes | Bacilli | Bacillales | Paenibacillaceae | *Paenibacillus* |
| 24 | Bacteria | Firmicutes | Bacilli | Bacillales | Paenibacillaceae | *Paenibacillus* |
| 25 | Bacteria | Firmicutes | Bacilli | Bacillales | Paenibacillaceae | *Paenibacillus* |
| 26 | Bacteria | Firmicutes | Bacilli | Bacillales | Paenibacillaceae | *Paenibacillus* |
| 27 | Bacteria | Proteobacteria | Betaproteobacteria | Burkholderiales | Oxalobacteraceae | *Massilia* |
| 28 | Bacteria | Proteobacteria | Betaproteobacteria | Burkholderiales | Oxalobacteraceae | *Massilia* |
| 29 | Bacteria | Proteobacteria | Betaproteobacteria | Burkholderiales | Burkholderiaceae | *Ralstonia* |
| 30 | Bacteria | Proteobacteria | Gammaproteobacteria | Pseudomonadales | Moraxellaceae | *Acinetobacter* |
| 31 | Bacteria | Proteobacteria | Gammaproteobacteria | Xanthomonadales | Xanthomonadaceae | *Luteibacter* |
| 32 | Bacteria | Proteobacteria | Betaproteobacteria | Burkholderiales | Comamonadaceae | *Variovorax* |
| 33 | Bacteria | Proteobacteria | Betaproteobacteria | Burkholderiales | Burkholderiaceae | *Ralstonia* |
| 34 | Bacteria | Firmicutes | Bacilli | Bacillales | Bacillaceae | *Bacillus* |
| 35 | Bacteria | Firmicutes | Bacilli | Bacillales | Bacillaceae | *Bacillus* |
| 36 | Bacteria | Firmicutes | Bacilli | Bacillales | Paenibacillaceae | *Paenibacillus* |
| 37 | Bacteria | Firmicutes | Bacilli | Bacillales | Paenibacillaceae | *Paenibacillus* |
| 38 | Bacteria | Proteobacteria | Betaproteobacteria | Burkholderiales | Burkholderiaceae | *Burkholderia* |
| 39 | Bacteria | Firmicutes | Bacilli | Bacillales | Bacillaceae | *Bacillus* |
| 40 | Bacteria | Proteobacteria | Gammaproteobacteria | Xanthomonadales | Xanthomonadaceae | *Luteibacter* |
| 41 | Bacteria | Proteobacteria | Betaproteobacteria | Burkholderiales | Burkholderiaceae | *Ralstonia* |
| 42 | Bacteria | Firmicutes | Bacilli | Bacillales | Bacillaceae | *Bacillus* |
| 43 | Bacteria | Actinobacteria | Actinobacteria | Actinomycetales | Microbacteriaceae | *Curtobacterium* |
| 44 | Bacteria | Actinobacteria | Actinobacteria | Actinomycetales | Microbacteriaceae | *Curtobacterium* |
| 45 | Bacteria | Proteobacteria | Gammaproteobacteria | Xanthomonadales | Xanthomonadaceae | *Luteibacter* |
| 46 | Bacteria | Proteobacteria | Gammaproteobacteria | Xanthomonadales | Xanthomonadaceae | *Luteibacter* |
| 47 | Bacteria | Proteobacteria | Gammaproteobacteria | Enterobacteriales | Enterobacteriaceae | *Pantoea* |
| 48 | Bacteria | Proteobacteria | Gammaproteobacteria | Xanthomonadales | Xanthomonadaceae | *Luteibacter* |
| 49 | Bacteria | Firmicutes | Bacilli | Bacillales | Bacillaceae | *Bacillus* |
| 50 | Bacteria | Firmicutes | Bacilli | Bacillales | Bacillaceae | *Bacillus* |
| 51 | Bacteria | Firmicutes | Bacilli | Bacillales | Paenibacillaceae | *Paenibacillus* |
| 52 | Bacteria | Firmicutes | Bacilli | Bacillales | Paenibacillaceae | *Paenibacillus* |
| 53 | Bacteria | Firmicutes | Bacilli | Bacillales | Bacillaceae | *Bacillus* |
| 54 | Bacteria | Firmicutes | Bacilli | Bacillales | Bacillaceae | *Bacillus* |
| 55 | Bacteria | Proteobacteria | Gammaproteobacteria | Enterobacteriales | Enterobacteriaceae | *Pantoea* |
| 56 | Bacteria | Proteobacteria | Alphaproteobacteria | Rhizobiales | Rhizobiaceae | *Rhizobium* |
| 57 | Bacteria | Proteobacteria | Gammaproteobacteria | Enterobacteriales | Enterobacteriaceae | *Pantoea* |
| 58 | Bacteria | Proteobacteria | Gammaproteobacteria | Xanthomonadales | Xanthomonadaceae | *Luteibacter* |
| 59 | Bacteria | Proteobacteria | Gammaproteobacteria | Xanthomonadales | Xanthomonadaceae | *Luteibacter* |
| 60 | Bacteria | Proteobacteria | Gammaproteobacteria | Xanthomonadales | Xanthomonadaceae | *Luteibacter* |
| 61 | Bacteria | Proteobacteria | Gammaproteobacteria | Xanthomonadales | Xanthomonadaceae | *Luteibacter* |
| 62 | Bacteria | Proteobacteria | Gammaproteobacteria | Enterobacteriales | Enterobacteriaceae | *Erwinia* |
| 63 | Bacteria | Proteobacteria | Gammaproteobacteria | Xanthomonadales | Xanthomonadaceae | *Luteibacter* |
| 64 | Bacteria | Proteobacteria | Gammaproteobacteria | Xanthomonadales | Xanthomonadaceae | *Luteibacter* |
| 65 | Bacteria | Proteobacteria | Gammaproteobacteria | Xanthomonadales | Xanthomonadaceae | *Luteibacter* |
| 66 | Bacteria | Proteobacteria | Gammaproteobacteria | Xanthomonadales | Xanthomonadaceae | *Luteibacter* |
| 67 | Bacteria | Proteobacteria | Gammaproteobacteria | Xanthomonadales | Xanthomonadaceae | *Luteibacter* |
| 68 | Bacteria | Proteobacteria | Gammaproteobacteria | Xanthomonadales | Xanthomonadaceae | *Luteibacter* |
| 69 | Bacteria | Proteobacteria | Gammaproteobacteria | Enterobacteriales | Enterobacteriaceae | *Erwinia* |
| 70 | Bacteria | Proteobacteria | Betaproteobacteria | Burkholderiales | Burkholderiaceae | *Ralstonia* |
| 71 | Bacteria | Proteobacteria | Gammaproteobacteria | Pseudomonadales | Pseudomonadaceae | *Pseudomonas* |
| 72 | Bacteria | Proteobacteria | Alphaproteobacteria | Caulobacterales | Caulobacteraceae | *Caulobacter* |
| 73 | Bacteria | Proteobacteria | Alphaproteobacteria | Caulobacterales | Caulobacteraceae | *Caulobacter* |
| 74 | Bacteria | Proteobacteria | Gammaproteobacteria | Pseudomonadales | Pseudomonadaceae | *Pseudomonas* |
| 75 | Bacteria | Proteobacteria | Gammaproteobacteria | Xanthomonadales | Xanthomonadaceae | *Stenotrophomonas* |
| 76 | Bacteria | Proteobacteria | Gammaproteobacteria | Pseudomonadales | Pseudomonadaceae | *Pseudomonas* |
| 77 | Bacteria | Proteobacteria | Gammaproteobacteria | Pseudomonadales | Pseudomonadaceae | *Pseudomonas* |
| 78 | Bacteria | Bacteroidetes | Cytophagia | Cytophagales | Cytophagaceae | *Hymenobacter* |

TABLE 1-continued

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 79 | Bacteria | Proteobacteria | Gammaproteobacteria | Pseudomonadales | Pseudomonadaceae | *Pseudomonas* |
| 80 | Bacteria | Proteobacteria | Gammaproteobacteria | Pseudomonadales | Pseudomonadaceae | *Pseudomonas* |
| 81 | Bacteria | Proteobacteria | Gammaproteobacteria | Pseudomonadales | Pseudomonadaceae | *Pseudomonas* |
| 82 | Bacteria | Proteobacteria | Gammaproteobacteria | Pseudomonadales | Pseudomonadaceae | *Pseudomonas* |
| 83 | Bacteria | Proteobacteria | Gammaproteobacteria | Pseudomonadales | Pseudomonadaceae | *Pseudomonas* |
| 84 | Bacteria | Proteobacteria | Betaproteobacteria | Burkholderiales | Comamonadaceae | *Pelomonas* |
| 85 | Bacteria | Proteobacteria | Alphaproteobacteria | Sphingomonadales | Sphingomonadaceae | *Sphingomonas* |
| 86 | Bacteria | Proteobacteria | Gammaproteobacteria | Pseudomonadales | Pseudomonadaceae | *Pseudomonas* |
| 87 | Bacteria | Proteobacteria | Gammaproteobacteria | Pseudomonadales | Pseudomonadaceae | *Pseudomonas* |
| 88 | Bacteria | Proteobacteria | Gammaproteobacteria | Pseudomonadales | Pseudomonadaceae | *Pseudomonas* |
| 89 | Bacteria | Proteobacteria | Gammaproteobacteria | Pseudomonadales | Pseudomonadaceae | *Pseudomonas* |
| 90 | Bacteria | Proteobacteria | Gammaproteobacteria | Pseudomonadales | Pseudomonadaceae | *Pseudomonas* |
| 91 | Bacteria | Proteobacteria | Gammaproteobacteria | Pseudomonadales | Pseudomonadaceae | *Pseudomonas* |
| 92 | Bacteria | Proteobacteria | Gammaproteobacteria | Pseudomonadales | Pseudomonadaceae | *Pseudomonas* |
| 93 | Bacteria | Proteobacteria | Gammaproteobacteria | Pseudomonadales | Pseudomonadaceae | *Pseudomonas* |
| 94 | Bacteria | Proteobacteria | Gammaproteobacteria | Pseudomonadales | Pseudomonadaceae | *Pseudomonas* |
| 95 | Bacteria | Proteobacteria | Gammaproteobacteria | Pseudomonadales | Pseudomonadaceae | *Pseudomonas* |
| 96 | Bacteria | Proteobacteria | Alphaproteobacteria | Sphingomonadales | Sphingomonadaceae | *Sphingomonas* |
| 97 | Bacteria | Proteobacteria | Gammaproteobacteria | Pseudomonadales | Pseudomonadaceae | *Pseudomonas* |
| 98 | Bacteria | Proteobacteria | Gammaproteobacteria | Pseudomonadales | Pseudomonadaceae | *Pseudomonas* |
| 99 | Bacteria | Proteobacteria | Gammaproteobacteria | Pseudomonadales | Pseudomonadaceae | *Pseudomonas* |
| 100 | Bacteria | Proteobacteria | Gammaproteobacteria | Pseudomonadales | Pseudomonadaceae | *Pseudomonas* |
| 101 | Bacteria | Proteobacteria | Gammaproteobacteria | Pseudomonadales | Pseudomonadaceae | *Pseudomonas* |
| 102 | Bacteria | Proteobacteria | Gammaproteobacteria | Pseudomonadales | Pseudomonadaceae | *Pseudomonas* |
| 103 | Bacteria | Proteobacteria | Gammaproteobacteria | Pseudomonadales | Pseudomonadaceae | *Pseudomonas* |
| 104 | Bacteria | Proteobacteria | Gammaproteobacteria | Pseudomonadales | Pseudomonadaceae | *Pseudomonas* |
| 105 | Bacteria | Actinobacteria | Actinobacteria | Actinomycetales | Nocardiaceae | *Rhodococcus* |
| 106 | Bacteria | Proteobacteria | Gammaproteobacteria | Pseudomonadales | Moraxellaceae | *Enhydrobacter* |
| 107 | Bacteria | Proteobacteria | Gammaproteobacteria | Pseudomonadales | Moraxellaceae | *Enhydrobacter* |
| 108 | Bacteria | Proteobacteria | Gammaproteobacteria | Pseudomonadales | Moraxellaceae | *Perlucidibaca* |
| 109 | Bacteria | Proteobacteria | Gammaproteobacteria | Xanthomonadales | Xanthomonadaceae | *Dyella* |
| 110 | Bacteria | Proteobacteria | Gammaproteobacteria | Enterobacteriales | Enterobacteriaceae | *Escherichia/Shigella* |
| 111 | Bacteria | Proteobacteria | Betaproteobacteria | Burkholderiales | Comamonadaceae | *Delftia* |
| 112 | Bacteria | Proteobacteria | Alphaproteobacteria | Rhizobiales | Bradyrhizobiaceae | *Oligotropha* |
| 113 | Bacteria | Actinobacteria | Actinobacteria | Actinomycetales | Microbacteriaceae | *Microbacterium* |
| 114 | Bacteria | Proteobacteria | Betaproteobacteria | Burkholderiales | Oxalobacteraceae | *Massilia* |
| 115 | Bacteria | Actinobacteria | Actinobacteria | Actinomycetales | Propionibacteriaceae | *Propionibacterium* |
| 116 | Bacteria | Actinobacteria | Actinobacteria | Actinomycetales | Microbacteriaceae | *Okibacterium* |
| 117 | Bacteria | Actinobacteria | Actinobacteria | Actinomycetales | Microbacteriaceae | *Microbacterium* |
| 118 | Bacteria | Actinobacteria | Actinobacteria | Actinomycetales | Microbacteriaceae | *Microbacterium* |
| 119 | Bacteria | Actinobacteria | Actinobacteria | Actinomycetales | Microbacteriaceae | *Microbacterium* |
| 120 | Bacteria | Bacteroidetes | Flavobacteriia | Flavobacteriales | Flavobacteriaceae | *Chryseobacterium* |
| 121 | Bacteria | Proteobacteria | Betaproteobacteria | Burkholderiales | Oxalobacteraceae | *Herbaspirillum* |
| 122 | Bacteria | Bacteroidetes | Flavobacteriia | Flavobacteriales | Flavobacteriaceae | *Chryseobacterium* |
| 123 | Bacteria | Proteobacteria | Alphaproteobacteria | Rhizobiales | Rhizobiaceae | *Rhizobium* |
| 124 | Bacteria | Proteobacteria | Alphaproteobacteria | Rhizobiales | Phyllobacteriaceae | *Mesorhizobium* |
| 125 | Bacteria | Proteobacteria | Alphaproteobacteria | Rhizobiales | Bradyrhizobiaceae | *Rhodopseudomonas* |
| 126 | Bacteria | Proteobacteria | Betaproteobacteria | Burkholderiales | Burkholderiaceae | *Burkholderia* |
| 127 | Bacteria | Proteobacteria | Betaproteobacteria | Burkholderiales | Oxalobacteraceae | *Herbaspirillum* |
| 128 | Archaea | Crenarchaeota | Thermoprotei | Sulfolobales | Sulfolobaceae | *Sulfurisphaera* |
| 129 | Bacteria | Proteobacteria | Gammaproteobacteria | Enterobacteriales | Enterobacteriaceae | *Kosakonia* |
| 130 | Bacteria | Actinobacteria | Actinobacteria | Actinomycetales | Streptomycetaceae | *Streptomyces* |
| 131 | Bacteria | Fusobacteria | Fusobacteriia | Fusobacteriales | Leptotrichiaceae | *Sebaldella* |
| 132 | Bacteria | Actinobacteria | Actinobacteria | Actinomycetales | Microbacteriaceae | *Curtobacterium* |
| 133 | Bacteria | Proteobacteria | Gammaproteobacteria | Pseudomonadales | Moraxellaceae | *Enhydrobacter* |
| 134 | Bacteria | Proteobacteria | Alphaproteobacteria | Sphingomonadales | Sphingomonadaceae | *Sphingomonas* |
| 135 | Bacteria | Proteobacteria | Alphaproteobacteria | Sphingomonadales | Sphingomonadaceae | *Sphingomonas* |
| 136 | Bacteria | Actinobacteria | Actinobacteria | Actinomycetales | Micromonosporaceae | *Actinoplanes* |
| 137 | Bacteria | Proteobacteria | Alphaproteobacteria | Rhizobiales | Beijerinckiaceae | *Beijerinckia* |
| 138 | Bacteria | Proteobacteria | Gammaproteobacteria | Enterobacteriales | Enterobacteriaceae | *Erwinia* |
| 139 | Bacteria | Proteobacteria | Alphaproteobacteria | Rhizobiales | Bradyrhizobiaceae | *Bradyrhizobium* |
| 140 | Bacteria | Proteobacteria | Alphaproteobacteria | Rhizobiales | Bradyrhizobiaceae | *Bradyrhizobium* |
| 141 | Bacteria | Proteobacteria | Alphaproteobacteria | Rhizobiales | Bradyrhizobiaceae | *Bradyrhizobium* |
| 142 | Bacteria | Proteobacteria | Alphaproteobacteria | Rhizobiales | Bradyrhizobiaceae | *Bradyrhizobium* |
| 143 | Bacteria | Proteobacteria | Alphaproteobacteria | Rhizobiales | Bradyrhizobiaceae | *Bradyrhizobium* |
| 144 | Bacteria | Proteobacteria | Alphaproteobacteria | Rhizobiales | Bradyrhizobiaceae | *Bradyrhizobium* |
| 145 | Bacteria | Proteobacteria | Alphaproteobacteria | Rhizobiales | Bradyrhizobiaceae | *Bradyrhizobium* |
| 146 | Bacteria | Proteobacteria | Alphaproteobacteria | Rhizobiales | Bradyrhizobiaceae | *Bradyrhizobium* |
| 147 | Bacteria | Actinobacteria | Actinobacteria | Actinomycetales | Intrasporangiaceae | *Oryzihumus* |
| 148 | Bacteria | Actinobacteria | Actinobacteria | Coriobacteriales | Coriobacteriaceae | *Adlercreutzia* |
| 149 | Bacteria | Proteobacteria | Betaproteobacteria | Burkholderiales | Comamonadaceae | *Variovorax* |
| 150 | Bacteria | Proteobacteria | Alphaproteobacteria | Rhizobiales | Phyllobacteriaceae | *Mesorhizobium* |
| 151 | Bacteria | Firmicutes | Bacilli | Bacillales | Incertae Sedis XII | *Exiguobacterium* |
| 152 | Bacteria | Firmicutes | Bacilli | Bacillales | Incertae Sedis XII | *Exiguobacterium* |
| 153 | Bacteria | Actinobacteria | Actinobacteria | Actinomycetales | incertae_sedis | *Sinosporangium* |

TABLE 1-continued

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 154 | Bacteria | Firmicutes | Bacilli | Bacillales | Staphylococcaceae | *Staphylococcus* |
| 155 | Bacteria | Firmicutes | Bacilli | Bacillales | Staphylococcaceae | *Staphylococcus* |
| 156 | Bacteria | Actinobacteria | Actinobacteria | Actinomycetales | incertae_sedis | *Sinosporangium* |
| 157 | Bacteria | Firmicutes | Bacilli | Bacillales | Bacillaceae | *Bacillus* |
| 158 | Bacteria | Firmicutes | Bacilli | Bacillales | Bacillaceae | *Bacillus* |
| 159 | Bacteria | Proteobacteria | Betaproteobacteria | Burkholderiales | Comamonadaceae | *Variovorax* |
| 160 | Bacteria | Proteobacteria | Betaproteobacteria | Burkholderiales | Comamonadaceae | *Variovorax* |
| 161 | Archaea | Crenarchaeota | Thermoprotei | Sulfolobales | Sulfolobaceae | *Stygiolobus* |
| 162 | Bacteria | Proteobacteria | Betaproteobacteria | Burkholderiales | Comamonadaceae | *Variovorax* |
| 163 | Bacteria | Proteobacteria | Alphaproteobacteria | Rhizobiales | Bradyrhizobiaceae | *Bradyrhizobium* |
| 164 | Bacteria | Proteobacteria | Alphaproteobacteria | Rhizobiales | Bradyrhizobiaceae | *Bradyrhizobium* |
| 165 | Bacteria | Firmicutes | Bacilli | Lactobacillales | Carnobacteriaceae | *Atopostipes* |
| 166 | Bacteria | Firmicutes | Bacilli | Lactobacillales | Carnobacteriaceae | *Atopostipes* |
| 167 | Bacteria | Proteobacteria | Gammaproteobacteria | Enterobacteriales | Enterobacteriaceae | *Serratia* |
| 168 | Bacteria | Proteobacteria | Gammaproteobacteria | Enterobacteriales | Enterobacteriaceae | *Serratia* |
| 169 | Archaea | Crenarchaeota | Thermoprotei | Sulfolobales | Sulfolobaceae | *Sulfurisphaera* |
| 170 | Bacteria | Verrucomicrobia | Opitutae | Puniceicoccales | Puniceicoccaceae | *Coraliomargarita* |
| 171 | Bacteria | Proteobacteria | Gammaproteobacteria | Enterobacteriales | Enterobacteriaceae | *Enterobacter* |
| 172 | Bacteria | Proteobacteria | Gammaproteobacteria | Enterobacteriales | Enterobacteriaceae | *Serratia* |
| 173 | Archaea | Euryarchaeota | Halobacteria | Halobacteriales | Halobacteriaceae | *Halobaculum* |
| 174 | Archaea | Euryarchaeota | Halobacteria | Halobacteriales | Halobacteriaceae | *Halosimplex* |
| 175 | Bacteria | Proteobacteria | Gammaproteobacteria | Xanthomonadales | Xanthomonadaceae | *Luteibacter* |
| 176 | Bacteria | Proteobacteria | Gammaproteobacteria | Xanthomonadales | Xanthomonadaceae | *Luteibacter* |
| 177 | Bacteria | Actinobacteria | Actinobacteria | Actinomycetales | Microbacteriaceae | *Pseudoclavibacter* |
| 178 | Bacteria | Actinobacteria | Actinobacteria | Actinomycetales | Microbacteriaceae | *Zimmermannella* |
| 179 | Bacteria | Proteobacteria | Gammaproteobacteria | Enterobacteriales | Enterobacteriaceae | *Serratia* |
| 180 | Bacteria | Proteobacteria | Gammaproteobacteria | Enterobacteriales | Enterobacteriaceae | *Serratia* |
| 181 | Bacteria | Proteobacteria | Gammaproteobacteria | Enterobacteriales | Enterobacteriaceae | *Serratia* |
| 182 | Bacteria | Proteobacteria | Gammaproteobacteria | Enterobacteriales | Enterobacteriaceae | *Serratia* |
| 183 | Bacteria | Proteobacteria | Gammaproteobacteria | Enterobacteriales | Enterobacteriaceae | *Serratia* |
| 184 | Bacteria | Proteobacteria | Gammaproteobacteria | Enterobacteriales | Enterobacteriaceae | *Serratia* |
| 185 | Bacteria | Proteobacteria | Gammaproteobacteria | Enterobacteriales | Enterobacteriaceae | *Serratia* |
| 186 | Bacteria | Proteobacteria | Gammaproteobacteria | Enterobacteriales | Enterobacteriaceae | *Serratia* |
| 187 | Bacteria | Proteobacteria | Gammaproteobacteria | Enterobacteriales | Enterobacteriaceae | *Serratia* |
| 188 | Bacteria | Proteobacteria | Gammaproteobacteria | Enterobacteriales | Enterobacteriaceae | *Serratia* |
| 189 | Bacteria | Proteobacteria | Gammaproteobacteria | Enterobacteriales | Enterobacteriaceae | *Serratia* |
| 190 | Bacteria | Proteobacteria | Betaproteobacteria | Burkholderiales | Comamonadaceae | *Variovorax* |
| 191 | Bacteria | Proteobacteria | Betaproteobacteria | Burkholderiales | Comamonadaceae | *Variovorax* |
| 192 | Bacteria | Firmicutes | Bacilli | Bacillales | Bacillaceae | *Bacillus* |
| 193 | Archaea | Nanohaloarchaeota | Nanohaloarchaea | Incertae sedis | Incertae sedis | *Candidatus Haloredivivus* |
| 194 | Archaea | Euryarchaeota | Archaeoglobi | Archaeoglobales | Archaeoglobaceae | *Ferroglobus* |
| 195 | Bacteria | Proteobacteria | Gammaproteobacteria | Xanthomonadales | Xanthomonadaceae | *Luteibacter* |
| 196 | Bacteria | Proteobacteria | Gammaproteobacteria | Xanthomonadales | Xanthomonadaceae | *Luteibacter* |
| 197 | Archaea | Nanohaloarchaeota | Nanohaloarchaea | Incertae sedis | Incertae sedis | *Candidatus Haloredivivus* |
| 198 | Archaea | Euryarchaeota | Archaeoglobi | Archaeoglobales | Archaeoglobaceae | *Ferroglobus* |
| 199 | Bacteria | Actinobacteria | Actinobacteria | Actinomycetales | Propionibacteriaceae | *Propionibacterium* |
| 200 | Bacteria | Proteobacteria | Alphaproteobacteria | Rhizobiales | Bradyrhizobiaceae | *Bradyrhizobium* |
| 201 | Bacteria | Proteobacteria | Alphaproteobacteria | Rhizobiales | Bradyrhizobiaceae | *Bradyrhizobium* |
| 202 | Bacteria | Firmicutes | Bacilli | Lactobacillales | Streptococcaceae | *Streptococcus* |
| 203 | Bacteria | Firmicutes | Bacilli | Lactobacillales | Streptococcaceae | *Streptococcus* |
| 204 | Bacteria | Firmicutes | Bacilli | Lactobacillales | Streptococcaceae | *Streptococcus* |
| 205 | Bacteria | Firmicutes | Bacilli | Lactobacillales | Streptococcaceae | *Streptococcus* |
| 206 | Bacteria | candidate division WPS-2 | Incertae sedis | Incertae sedis | Incertae sedis | WPS-2_genera_incertae_sedis |
| 207 | Bacteria | Proteobacteria | Alphaproteobacteria | Rhizobiales | Bradyrhizobiaceae | *Afipia* |
| 208 | Bacteria | Proteobacteria | Alphaproteobacteria | Rhizobiales | Bradyrhizobiaceae | *Rhodopseudomonas* |
| 209 | Bacteria | Firmicutes | Bacilli | Lactobacillales | Streptococcaceae | *Streptococcus* |
| 210 | Bacteria | Firmicutes | Bacilli | Lactobacillales | Streptococcaceae | *Streptococcus* |
| 211 | Bacteria | Cyanobacteria | Incertae sedis | Incertae sedis | Incertae sedis | *Incertae sedis* |
| 212 | Bacteria | Cyanobacteria | Incertae sedis | Incertae sedis | Incertae sedis | *Incertae sedis* |
| 213 | Bacteria | Proteobacteria | Gammaproteobacteria | Pseudomonadales | Pseudomonadaceae | *Pseudomonas* |
| 214 | Bacteria | Proteobacteria | Gammaproteobacteria | Pseudomonadales | Pseudomonadaceae | *Pseudomonas* |
| 215 | Bacteria | Firmicutes | Bacilli | Lactobacillales | Lactobacillaceae | *Lactobacillus* |
| 216 | Bacteria | Firmicutes | Bacilli | Lactobacillales | Lactobacillaceae | *Lactobacillus* |
| 217 | Bacteria | Cyanobacteria | Incertae sedis | Incertae sedis | Incertae sedis | *Incertae sedis* |
| 218 | Bacteria | Cyanobacteria | Incertae sedis | Incertae sedis | Incertae sedis | *Incertae sedis* |
| 219 | Bacteria | Firmicutes | Bacilli | Lactobacillales | Streptococcaceae | *Streptococcus* |
| 220 | Bacteria | Firmicutes | Bacilli | Lactobacillales | Streptococcaceae | *Streptococcus* |
| 221 | Bacteria | Proteobacteria | Alphaproteobacteria | Rhizobiales | Rhizobiaceae | *Rhizobium* |
| 222 | Bacteria | Proteobacteria | Alphaproteobacteria | Rhizobiales | Rhizobiaceae | *Rhizobium* |
| 223 | Bacteria | Proteobacteria | Alphaproteobacteria | Rhizobiales | Rhizobiaceae | *Rhizobium* |
| 224 | Bacteria | Proteobacteria | Alphaproteobacteria | Rhizobiales | Rhizobiaceae | *Rhizobium* |
| 225 | Bacteria | Firmicutes | Bacilli | Lactobacillales | Streptococcaceae | *Streptococcus* |

TABLE 1-continued

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 226 | Bacteria | Firmicutes | Bacilli | Lactobacillales | Streptococcaceae | *Streptococcus* |
| 227 | Bacteria | Proteobacteria | Alphaproteobacteria | Rhizobiales | Bradyrhizobiaceae | *Bradyrhizobium* |
| 228 | Bacteria | Proteobacteria | Alphaproteobacteria | Rhizobiales | Bradyrhizobiaceae | *Bradyrhizobium* |
| 229 | Bacteria | Proteobacteria | Alphaproteobacteria | Rhizobiales | Rhizobiaceae | *Rhizobium* |
| 230 | Bacteria | Proteobacteria | Alphaproteobacteria | Rhizobiales | Rhizobiaceae | *Rhizobium* |
| 231 | Bacteria | Proteobacteria | Betaproteobacteria | Burkholderiales | Burkholderiaceae | *Polynucleobacter* |
| 232 | Bacteria | Proteobacteria | Betaproteobacteria | Burkholderiales | Burkholderiaceae | *Polynucleobacter* |
| 233 | Bacteria | Proteobacteria | Alphaproteobacteria | Rhizobiales | Rhizobiaceae | *Rhizobium* |
| 234 | Bacteria | Bacteroidetes | Sphingobacteriia | Sphingobacteriales | Chitinophagaceae | *Filimonas* |
| 235 | Bacteria | Bacteroidetes | Sphingobacteriia | Sphingobacteriales | Chitinophagaceae | *Filimonas* |
| 236 | Bacteria | Bacteroidetes | Sphingobacteriia | Sphingobacteriales | Chitinophagaceae | *Filimonas* |
| 237 | Bacteria | Proteobacteria | Gammaproteobacteria | Enterobacteriales | Enterobacteriaceae | *Pantoea* |
| 238 | Bacteria | Proteobacteria | Gammaproteobacteria | Enterobacteriales | Enterobacteriaceae | *Enterobacter* |
| 239 | Bacteria | Firmicutes | Bacilli | Lactobacillales | Leuconostocaceae | *Leuconostoc* |
| 240 | Bacteria | Firmicutes | Clostridia | Clostridiales | Clostridiaceae | *Clostridium* |
| 241 | Bacteria | Firmicutes | Bacilli | Bacillales | Bacillaceae | *Bacillus* |
| 242 | Bacteria | Firmicutes | Bacilli | Bacillales | Bacillaceae | *Bacillus* |
| 243 | Bacteria | Firmicutes | Bacilli | Bacillales | Bacillaceae | *Bacillus* |
| 244 | Bacteria | Firmicutes | Bacilli | Lactobacillales | Leuconostocaceae | *Weissella* |
| 245 | Bacteria | Firmicutes | Bacilli | Bacillales | Paenibacillaceae | *Paenibacillus* |
| 246 | Bacteria | Proteobacteria | Gammaproteobacteria | Pseudomonadales | Pseudomonadaceae | *Pseudomonas* |
| 247 | Bacteria | Firmicutes | Bacilli | Lactobacillales | Streptococcaceae | *Lactococcus* |
| 248 | Bacteria | Firmicutes | Bacilli | Bacillales | Paenibacillaceae | *Paenibacillus* |
| 249 | Bacteria | Firmicutes | Bacilli | Bacillales | [Exiguobacteraceae] | *Exiguobacterium* |
| 250 | Bacteria | Proteobacteria | Alphaproteobacteria | Sphingomonadales | Sphingomonadaceae | *Sphingomonas* |
| 251 | Bacteria | Proteobacteria | Gammaproteobacteria | Pseudomonadales | Pseudomonadaceae | *Pseudomonas* |
| 252 | Bacteria | Proteobacteria | Betaproteobacteria | Burkholderiales | Oxalobacteraceae | *Janthinobacterium* |
| 253 | Bacteria | Firmicutes | Bacilli | Bacillales | Paenibacillaceae | *Paenibacillus* |
| 254 | Bacteria | Firmicutes | Bacilli | Bacillales | Paenibacillaceae | |
| 255 | Bacteria | Proteobacteria | Gammaproteobacteria | Pseudomonadales | Pseudomonadaceae | unclassified |
| 256 | Bacteria | Firmicutes | Bacilli | Bacillales | Bacillaceae | *Bacillus* |
| 257 | Bacteria | Proteobacteria | Gammaproteobacteria | Pseudomonadales | Pseudomonadaceae | *Pseudomonas* |
| 258 | Bacteria | Proteobacteria | Betaproteobacteria | Burkholderiales | Oxalobacteraceae | |
| 259 | Bacteria | Bacteroidetes | Flavobacteriia | Flavobacteriales | [Weeksellaceae] | *Chryseobacterium* |
| 260 | Bacteria | Proteobacteria | Gammaproteobacteria | Pseudomonadales | Pseudomonadaceae | *Pseudomonas* |
| 261 | Bacteria | Proteobacteria | Betaproteobacteria | Burkholderiales | Burkholderiaceae | *Burkholderia* |
| 262 | Bacteria | Proteobacteria | Gammaproteobacteria | Pseudomonadales | Pseudomonadaceae | *Pseudomonas* |
| 263 | Bacteria | Firmicutes | Bacilli | Bacillales | Bacillaceae | *Bacillus* |
| 264 | Bacteria | Proteobacteria | Betaproteobacteria | Burkholderiales | Oxalobacteraceae | |
| 265 | Bacteria | Proteobacteria | Gammaproteobacteria | Pseudomonadales | Pseudomonadaceae | *Pseudomonas* |
| 266 | Bacteria | Actinobacteria | Actinobacteria | Actinomycetales | Brevibacteriaceae | *Brevibacterium* |
| 267 | Bacteria | Proteobacteria | Alphaproteobacteria | Rhizobiales | Rhizobiaceae | *Agrobacterium* |
| 268 | Bacteria | Firmicutes | Clostridia | Clostridiales | Clostridiaceae | *Clostridium* |
| 269 | Bacteria | Proteobacteria | Alphaproteobacteria | Sphingomonadales | Sphingomonadaceae | *Sphingomonas* |
| 270 | Bacteria | Firmicutes | Bacilli | Bacillales | Planococcaceae | unclassified |
| 271 | Bacteria | Proteobacteria | Gammaproteobacteria | Pseudomonadales | Pseudomonadaceae | *Pseudomonas* |
| 272 | Bacteria | Bacteroidetes | Sphingobacteriia | Sphingobacteriales | | |
| 273 | Bacteria | Proteobacteria | Gammaproteobacteria | Xanthomonadales | Xanthomonadaceae | *Xanthomonas* |
| 274 | Bacteria | Firmicutes | Bacilli | Bacillales | Paenibacillaceae | *Saccharibacillus* |
| 275 | Bacteria | Proteobacteria | Gammaproteobacteria | Pseudomonadales | Pseudomonadaceae | unclassified |
| 276 | Bacteria | Actinobacteria | Actinobacteria | Actinomycetales | Microbacteriaceae | unclassified |
| 277 | Bacteria | Firmicutes | Bacilli | Bacillales | Paenibacillaceae | *Paenibacillus* |
| 278 | Bacteria | Proteobacteria | Alphaproteobacteria | Sphingomonadales | Sphingomonadaceae | unclassified |
| 279 | Bacteria | Proteobacteria | Alphaproteobacteria | Sphingomonadales | Sphingomonadaceae | *Novosphingobium* |
| 280 | Bacteria | Proteobacteria | Alphaproteobacteria | Sphingomonadales | Sphingomonadaceae | *Novosphingobium* |
| 281 | Bacteria | Proteobacteria | Alphaproteobacteria | Rhizobiales | Methylobacteriaceae | *Methylobacterium* |
| 282 | Bacteria | Firmicutes | Bacilli | Bacillales | Bacillaceae | unclassified |
| 283 | Bacteria | Actinobacteria | Actinobacteria | Actinomycetales | Sanguibacteraceae | *Sanguibacter* |
| 284 | Bacteria | Bacteroidetes | [Saprospirae] | [Saprospirales] | Saprospiraceae | |
| 285 | Bacteria | Firmicutes | Bacilli | Lactobacillales | Lactobacillaceae | |
| 286 | Bacteria | Proteobacteria | Alphaproteobacteria | Caulobacterales | Caulobacteraceae | *Mycoplana* |
| 287 | Bacteria | Proteobacteria | Alphaproteobacteria | Sphingomonadales | Sphingomonadaceae | *Sphingomonas* |
| 288 | Bacteria | Proteobacteria | Gammaproteobacteria | Enterobacteriales | Enterobacteriaceae | *Escherichia* |
| 289 | Bacteria | Proteobacteria | Alphaproteobacteria | Rhizobiales | Methylobacteriaceae | *Methylobacterium* |
| 290 | Bacteria | Cyanobacteria | unclassified | unclassified | unclassified | unclassified |
| 291 | Bacteria | Proteobacteria | Alphaproteobacteria | Sphingomonadales | Sphingomonadaceae | *Sphingomonas* |
| 292 | Bacteria | Proteobacteria | Gammaproteobacteria | Oceanospirillales | Halomonadaceae | *Halomonas* |
| 293 | Bacteria | Proteobacteria | Alphaproteobacteria | Rhizobiales | Methylobacteriaceae | |
| 294 | Bacteria | Proteobacteria | Alphaproteobacteria | Rhizobiales | Aurantimonadaceae | |
| 295 | Bacteria | Bacteroidetes | Sphingobacteriia | Sphingobacteriales | Sphingobacteriaceae | *Pedobacter* |
| 296 | Bacteria | Proteobacteria | Deltaproteobacteria | Myxococcales | | |
| 297 | Bacteria | Actinobacteria | Actinobacteria | Actinomycetales | Corynebacteriaceae | *Corynebacterium* |
| 298 | Bacteria | Firmicutes | Bacilli | Lactobacillales | Streptococcaceae | *Streptococcus* |
| 299 | Bacteria | Firmicutes | Bacilli | Bacillales | Alicyclobacillaceae | *Alicyclobacillus* |
| 300 | Bacteria | Proteobacteria | Gammaproteobacteria | Enterobacteriales | Enterobacteriaceae | unclassified |

TABLE 1-continued

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 301 | Bacteria | Bacteroidetes | Cytophagia | Cytophagales | Cytophagaceae | *Hymenobacter* |
| 302 | Bacteria | Proteobacteria | Gammaproteobacteria | Xanthomonadales | Xanthomonadaceae | *Xanthomonas* |
| 303 | Bacteria | Firmicutes | Bacilli | Lactobacillales | Lactobacillaceae | *Lactobacillus* |
| 304 | Bacteria | Proteobacteria | Alphaproteobacteria | Sphingomonadales | Erythrobacteraceae | |
| 305 | Bacteria | Proteobacteria | Alphaproteobacteria | Rhizobiales | Methylobacteriaceae | *Methylobacterium* |
| 306 | Bacteria | Bacteroidetes | [Saprospirae] | [Saprospirales] | Chitinophagaceae | *Sediminibacterium* |
| 307 | Bacteria | Proteobacteria | Alphaproteobacteria | Caulobacterales | Caulobacteraceae | *Asticcacaulis* |
| 308 | Bacteria | Bacteroidetes | Flavobacteriia | Flavobacteriales | [Weeksellaceae] | *Chryseobacterium* |
| 309 | Bacteria | Proteobacteria | Alphaproteobacteria | Rhizobiales | Rhizobiaceae | *Rhizobium* |
| 310 | Bacteria | Actinobacteria | Actinobacteria | Actinomycetales | Micrococcaceae | |
| 311 | Bacteria | Bacteroidetes | Flavobacteriia | Flavobacteriales | [Weeksellaceae] | *Chryseobacterium* |
| 312 | Bacteria | Firmicutes | Bacilli | Bacillales | Staphylococcaceae | *Staphylococcus* |
| 313 | Bacteria | Proteobacteria | Betaproteobacteria | Burkholderiales | Oxalobacteraceae | *Ralstonia* |
| 314 | Bacteria | Proteobacteria | Gammaproteobacteria | Pseudomonadales | Pseudomonadaceae | *Pseudomonas* |
| 315 | Bacteria | Proteobacteria | Alphaproteobacteria | Rhizobiales | Methylobacteriaceae | *Methylobacterium* |
| 316 | Bacteria | Proteobacteria | Gammaproteobacteria | Alteromonadales | Alteromonadaceae | *Cellvibrio* |
| 317 | Bacteria | Firmicutes | Bacilli | Bacillales | Bacillaceae | unclassified |
| 318 | Bacteria | Firmicutes | Bacilli | Bacillales | Planococcaceae | *Solibacillus* |
| 319 | Bacteria | Proteobacteria | Gammaproteobacteria | Legionellales | Coxiellaceae | *Aquicella* |
| 320 | Bacteria | Proteobacteria | Alphaproteobacteria | Rhizobiales | Methylocystaceae | |
| 321 | Bacteria | Actinobacteria | Actinobacteria | Actinomycetales | Microbacteriaceae | *Yonghaparkia* |
| 322 | Bacteria | Proteobacteria | Gammaproteobacteria | Pseudomonadales | Pseudomonadaceae | unclassified |
| 323 | Bacteria | Proteobacteria | Gammaproteobacteria | Pseudomonadales | Moraxellaceae | *Acinetobacter* |
| 324 | Bacteria | Actinobacteria | Actinobacteria | Actinomycetales | Streptomycetaceae | *Streptomyces* |
| 325 | Bacteria | Firmicutes | Bacilli | Lactobacillales | Leuconostocaceae | |
| 326 | Bacteria | Actinobacteria | Actinobacteria | Actinomycetales | Micromonosporaceae | *Actinoplanes* |
| 327 | Bacteria | Bacteroidetes | Sphingobacteriia | Sphingobacteriales | Sphingobacteriaceae | *Pedobacter* |
| 328 | Bacteria | Tenericutes | Mollicutes | Mycoplasmatales | Mycoplasmataceae | *Mycoplasma* |
| 329 | Bacteria | Actinobacteria | Actinobacteria | Actinomycetales | Microbacteriaceae | unclassified |
| 330 | Bacteria | Bacteroidetes | Sphingobacteriia | Sphingobacteriales | Sphingobacteriaceae | |
| 331 | Bacteria | Proteobacteria | Betaproteobacteria | Burkholderiales | Oxalobacteraceae | unclassified |
| 332 | Bacteria | Actinobacteria | Actinobacteria | Actinomycetales | Streptomycetaceae | |
| 333 | Bacteria | Proteobacteria | Betaproteobacteria | Burkholderiales | Oxalobacteraceae | *Herbaspirillum* |
| 334 | Bacteria | Proteobacteria | Betaproteobacteria | Burkholderiales | Comamonadaceae | unclassified |
| 335 | Bacteria | Acidobacteria | Acidobacteriia | Acidobacteriales | Acidobacteriaceae | |
| 336 | Bacteria | Proteobacteria | Gammaproteobacteria | Xanthomonadales | Xanthomonadaceae | *Arenimonas* |
| 337 | Bacteria | Actinobacteria | Actinobacteria | Actinomycetales | Micrococcaceae | *Arthrobacter* |
| 338 | Bacteria | Proteobacteria | Alphaproteobacteria | Rhizobiales | Bradyrhizobiaceae | *Bradyrhizobium* |
| 339 | Bacteria | Proteobacteria | Alphaproteobacteria | Sphingomonadales | Erythrobacteraceae | |
| 340 | Bacteria | Firmicutes | Clostridia | Clostridiales | [Tissierellaceae] | *Peptoniphilus* |
| 341 | Bacteria | Bacteroidetes | Sphingobacteriia | Sphingobacteriales | Sphingobacteriaceae | |
| 342 | Bacteria | Bacteroidetes | Sphingobacteriia | Sphingobacteriales | Sphingobacteriaceae | *Pedobacter* |
| 343 | Bacteria | Proteobacteria | Gammaproteobacteria | Enterobacteriales | Enterobacteriaceae | *Enterobacter* |
| 344 | Bacteria | Actinobacteria | Actinobacteria | Actinomycetales | Nocardiaceae | *Rhodococcus* |
| 345 | Bacteria | Bacteroidetes | Flavobacteriia | Flavobacteriales | [Weeksellaceae] | *Chryseobacterium* |
| 346 | Bacteria | Proteobacteria | Betaproteobacteria | Burkholderiales | Oxalobacteraceae | *Janthinobacterium* |
| 347 | Bacteria | Firmicutes | Bacilli | Bacillales | Paenibacillaceae | *Paenibacillus* |
| 348 | Bacteria | Actinobacteria | Actinobacteria | Actinomycetales | Actinosynnemataceae | |
| 349 | Bacteria | Actinobacteria | Actinobacteria | Actinomycetales | Nocardioidaceae | *Aeromicrobium* |
| 350 | Bacteria | Actinobacteria | Actinobacteria | Actinomycetales | Microbacteriaceae | *Rathayibacter* |
| 351 | Bacteria | Actinobacteria | Actinobacteria | Actinomycetales | Microbacteriaceae | *Salinibacterium* |
| 352 | Bacteria | Proteobacteria | Betaproteobacteria | Burkholderiales | Comamonadaceae | |
| 353 | Bacteria | Actinobacteria | Actinobacteria | Actinomycetales | Nocardioidaceae | *Nocardioides* |
| 354 | Bacteria | Proteobacteria | Betaproteobacteria | Burkholderiales | Comamonadaceae | *Polaromonas* |
| 355 | Bacteria | Actinobacteria | Actinobacteria | Actinomycetales | Actinosynnemataceae | *Lentzea* |
| 356 | Bacteria | Proteobacteria | Betaproteobacteria | Burkholderiales | Comamonadaceae | unclassified |
| 357 | Bacteria | Proteobacteria | Alphaproteobacteria | Caulobacterales | Caulobacteraceae | *Caulobacter* |
| 358 | Bacteria | Bacteroidetes | Flavobacteriia | Flavobacteriales | Flavobacteriaceae | *Flavobacterium* |
| 359 | Bacteria | Proteobacteria | Gammaproteobacteria | Enterobacteriales | Enterobacteriaceae | unclassified |
| 360 | Bacteria | Proteobacteria | Gammaproteobacteria | Xanthomonadales | Xanthomonadaceae | *Stenotrophomonas* |
| 361 | Bacteria | Firmicutes | Clostridia | Thermoanaerobacterales | Caldicellulosiruptoraceae | *Caldicellulosiruptor* |
| 362 | Bacteria | Proteobacteria | Gammaproteobacteria | Xanthomonadales | Xanthomonadaceae | *Rhodanobacter* |
| 363 | Bacteria | Proteobacteria | Alphaproteobacteria | Sphingomonadales | Sphingomonadaceae | *Sphingomonas* |
| 364 | Bacteria | Bacteroidetes | [Saprospirae] | [Saprospirales] | Chitinophagaceae | *Lacibacter* |
| 365 | Bacteria | Actinobacteria | Actinobacteria | Actinomycetales | Nocardioidaceae | *Kribbella* |
| 366 | Bacteria | Bacteroidetes | Cytophagia | Cytophagales | Cytophagaceae | *Hymenobacter* |
| 367 | Bacteria | Proteobacteria | Deltaproteobacteria | Syntrophobacterales | Syntrophobacteraceae | |
| 368 | Bacteria | Firmicutes | Clostridia | Clostridiales | Clostridiaceae | *Caloramator* |
| 369 | Bacteria | Proteobacteria | Gammaproteobacteria | Pseudomonadales | Pseudomonadaceae | *Pseudomonas* |
| 370 | Bacteria | Proteobacteria | Alphaproteobacteria | Sphingomonadales | Sphingomonadaceae | *Sphingomonas* |
| 371 | Bacteria | Actinobacteria | Actinobacteria | Actinomycetales | Microbacteriaceae | *Salinibacterium* |
| 372 | Bacteria | Actinobacteria | Actinobacteria | Actinomycetales | Promicromonosporaceae | *Promicromonospora* |
| 373 | Bacteria | Firmicutes | Bacilli | Bacillales | Planococcaceae | *Lysinibacillus* |
| 374 | Bacteria | Proteobacteria | Alphaproteobacteria | Rhizobiales | Hyphomicrobiaceae | *Devosia* |
| 375 | Bacteria | Proteobacteria | Alphaproteobacteria | Rhizobiales | Aurantimonadaceae | |

TABLE 1-continued

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 376 | Bacteria | Firmicutes | Bacilli | Bacillales | unclassified | unclassified |
| 377 | Bacteria | Proteobacteria | Gammaproteobacteria | Xanthomonadales | Xanthomonadaceae | *Stenotrophomonas* |
| 378 | Bacteria | Bacteroidetes | Sphingobacteriia | Sphingobacteriales | Sphingobacteriaceae | *Pedobacter* |
| 379 | Bacteria | Actinobacteria | Actinobacteria | Actinomycetales | Nocardioidaceae | |
| 380 | Bacteria | Firmicutes | Clostridia | Clostridiales | Clostridiaceae | *Thermoanaerobacterium* |
| 381 | Bacteria | Actinobacteria | Actinobacteria | Actinomycetales | Kineosporiaceae | *Kineococcus* |
| 382 | Bacteria | Proteobacteria | Betaproteobacteria | Burkholderiales | Comamonadaceae | unclassified |
| 383 | Bacteria | Bacteroidetes | Cytophagia | Cytophagales | Cytophagaceae | *Dyadobacter* |
| 384 | Bacteria | Proteobacteria | Deltaproteobacteria | Bdellovibrionales | Bacteriovoracaceae | *Peredibacter* |
| 385 | Bacteria | Proteobacteria | Deltaproteobacteria | Myxococcales | Cystobacterineae | |
| 386 | Bacteria | Bacteroidetes | Cytophagia | Cytophagales | Cytophagaceae | *Hymenobacter* |
| 387 | Bacteria | Proteobacteria | Betaproteobacteria | Burkholderiales | Oxalobacteraceae | *Janthinobacterium* |
| 388 | Bacteria | Proteobacteria | Alphaproteobacteria | Rhodospirillales | Acetobacteraceae | |
| 389 | Bacteria | Bacteroidetes | Flavobacteriia | Flavobacteriales | Flavobacteriaceae | *Flavobacterium* |
| 390 | Bacteria | Bacteroidetes | Flavobacteriia | Flavobacteriales | Flavobacteriaceae | *Flavobacterium* |
| 391 | Bacteria | Proteobacteria | Alphaproteobacteria | Rhizobiales | Hyphomicrobiaceae | *Devosia* |
| 392 | Bacteria | Proteobacteria | Gammaproteobacteria | Enterobacteriales | Enterobacteriaceae | unclassified |
| 393 | Bacteria | Firmicutes | Clostridia | Thermoanaerobacterales | Carboxydocellaceae | *Carboxydocella* |
| 394 | Bacteria | Actinobacteria | Actinobacteria | Actinomycetales | Streptomycetaceae | *Streptomyces* |
| 395 | Bacteria | Proteobacteria | Alphaproteobacteria | Caulobacterales | Caulobacteraceae | *Caulobacter* |
| 396 | Bacteria | Proteobacteria | Alphaproteobacteria | Sphingomonadales | Sphingomonadaceae | unclassified |
| 397 | Bacteria | Proteobacteria | Gammaproteobacteria | Xanthomonadales | Xanthomonadaceae | *Luteibacter* |
| 398 | Bacteria | Actinobacteria | Actinobacteria | Actinomycetales | Corynebacteriaceae | *Corynebacterium* |
| 399 | Bacteria | Proteobacteria | Alphaproteobacteria | Sphingomonadales | Sphingomonadaceae | *Sphingomonas* |
| 400 | Bacteria | Proteobacteria | Betaproteobacteria | Burkholderiales | Comamonadaceae | unclassified |
| 401 | Bacteria | Proteobacteria | Betaproteobacteria | Burkholderiales | Oxalobacteraceae | *Janthinobacterium* |
| 402 | Bacteria | Proteobacteria | Gammaproteobacteria | Xanthomonadales | Xanthomonadaceae | *Rhodanobacter* |
| 403 | Bacteria | Proteobacteria | Gammaproteobacteria | Pseudomonadales | Moraxellaceae | *Acinetobacter* |
| 404 | Bacteria | Proteobacteria | Alphaproteobacteria | Sphingomonadales | Sphingomonadaceae | *Kaistobacter* |
| 405 | Bacteria | Proteobacteria | Alphaproteobacteria | Sphingomonadales | Sphingomonadaceae | *Sphingomonas* |
| 406 | Bacteria | Fibrobacteres | Fibrobacteria | 258ds10 | | |
| 407 | Bacteria | Actinobacteria | Actinobacteria | Actinomycetales | Corynebacteriaceae | *Corynebacterium* |
| 408 | Bacteria | Proteobacteria | Gammaproteobacteria | Pseudomonadales | Moraxellaceae | *Enhydrobacter* |
| 409 | Bacteria | Firmicutes | Bacilli | Bacillales | Bacillaceae | *Geobacillus* |
| 410 | Bacteria | Bacteroidetes | Cytophagia | Cytophagales | Cytophagaceae | *Hymenobacter* |
| 411 | Bacteria | Actinobacteria | Actinobacteria | Actinomycetales | Geodermatophilaceae | |
| 412 | Bacteria | Actinobacteria | Actinobacteria | Actinomycetales | Mycobacteriaceae | *Mycobacterium* |
| 413 | Bacteria | Proteobacteria | Alphaproteobacteria | Rhizobiales | Hyphomicrobiaceae | *Devosia* |
| 414 | Bacteria | Proteobacteria | Alphaproteobacteria | Sphingomonadales | Sphingomonadaceae | *Sphingomonas* |
| 415 | Bacteria | Proteobacteria | Alphaproteobacteria | Sphingomonadales | Sphingomonadaceae | *Sphingomonas* |
| 416 | Bacteria | Proteobacteria | Gammaproteobacteria | Enterobacteriales | Enterobacteriaceae | *Pantoea* |
| 417 | Bacteria | Proteobacteria | Alphaproteobacteria | Caulobacterales | Caulobacteraceae | unclassified |
| 418 | Bacteria | Proteobacteria | Alphaproteobacteria | Sphingomonadales | Sphingomonadaceae | *Sphingopyxis* |
| 419 | Bacteria | Firmicutes | Bacilli | Bacillales | Sporolactobacillaceae | *Bacillus* |
| 420 | Bacteria | Bacteroidetes | Sphingobacteriia | Sphingobacteriales | Sphingobacteriaceae | |
| 421 | Bacteria | Proteobacteria | Alphaproteobacteria | Sphingomonadales | Sphingomonadaceae | *Sphingomonas* |
| 422 | Bacteria | Bacteroidetes | Cytophagia | Cytophagales | Cytophagaceae | |
| 423 | Bacteria | Firmicutes | Bacilli | Lactobacillales | Streptococcaceae | *Streptococcus* |
| 424 | Bacteria | Proteobacteria | Betaproteobacteria | Burkholderiales | Comamonadaceae | *Comamonas* |
| 425 | Bacteria | Actinobacteria | Actinobacteria | Actinomycetales | Microbacteriaceae | |
| 426 | Bacteria | Firmicutes | Clostridia | Clostridiales | Clostridiaceae | *Clostridium* |
| 427 | Bacteria | Bacteroidetes | Cytophagia | Cytophagales | Cyclobacteriaceae | *Algoriphagus* |
| 428 | Bacteria | [Thermi] | Deinococci | Deinococcales | Deinococcaceae | *Deinococcus* |
| 429 | Bacteria | Actinobacteria | Thermoleophilia | Solirubrobacterales | | |
| 430 | Bacteria | Actinobacteria | Actinobacteria | Actinomycetales | Nocardioidaceae | *Nocardioides* |
| 431 | Bacteria | Actinobacteria | Actinobacteria | Actinomycetales | Kineosporiaceae | *Quadrisphaera* |
| 432 | Bacteria | Bacteroidetes | Cytophagia | Cytophagales | Cytophagaceae | |
| 433 | Bacteria | Proteobacteria | Gammaproteobacteria | Enterobacteriales | Enterobacteriaceae | *Erwinia* |
| 434 | Bacteria | Proteobacteria | Gammaproteobacteria | Enterobacteriales | Enterobacteriaceae | unclassified |
| 435 | Bacteria | Proteobacteria | Alphaproteobacteria | Sphingomonadales | Sphingomonadaceae | *Sphingomonas* |
| 436 | Bacteria | Proteobacteria | Betaproteobacteria | Burkholderiales | Alcaligenaceae | *Achromobacter* |
| 437 | Bacteria | Proteobacteria | Alphaproteobacteria | Rhizobiales | Methylobacteriaceae | *Methylobacterium* |
| 438 | Bacteria | Proteobacteria | Gammaproteobacteria | Xanthomonadales | Xanthomonadaceae | unclassified |
| 439 | Bacteria | Proteobacteria | Alphaproteobacteria | Sphingomonadales | Sphingomonadaceae | *Kaistobacter* |
| 440 | Bacteria | Proteobacteria | Alphaproteobacteria | Rhizobiales | Bradyrhizobiaceae | *Bosea* |
| 441 | Bacteria | Firmicutes | Bacilli | Bacillales | Paenibacillaceae | *Brevibacillus* |
| 442 | Bacteria | Proteobacteria | Alphaproteobacteria | Sphingomonadales | Sphingomonadaceae | *Sphingomonas* |
| 443 | Bacteria | Proteobacteria | Betaproteobacteria | Burkholderiales | Comamonadaceae | *Methylibium* |
| 444 | Bacteria | Actinobacteria | Actinobacteria | Actinomycetales | Dermabacteraceae | *Brachybacterium* |
| 445 | Bacteria | Actinobacteria | Actinobacteria | Actinomycetales | Nocardioidaceae | |
| 446 | Bacteria | Proteobacteria | Alphaproteobacteria | Rhizobiales | Methylobacteriaceae | *Methylobacterium* |
| 447 | Bacteria | Proteobacteria | Betaproteobacteria | Burkholderiales | Alcaligenaceae | *Pigmentiphaga* |
| 448 | Bacteria | Bacteroidetes | Flavobacteriia | Flavobacteriales | Flavobacteriaceae | *Flavobacterium* |
| 449 | Bacteria | Actinobacteria | Actinobacteria | Actinomycetales | Corynebacteriaceae | *Corynebacterium* |
| 450 | Bacteria | Actinobacteria | Actinobacteria | Actinomycetales | unclassified | unclassified |

TABLE 1-continued

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 451 | Bacteria | Bacteroidetes | Sphingobacteriia | Sphingobacteriales | Sphingobacteriaceae | unclassified |
| 452 | Bacteria | Acidobacteria | [Chloracidobacteria] | RB41 | Ellin6075 | |
| 453 | Bacteria | Proteobacteria | Alphaproteobacteria | Rhizobiales | Hyphomicrobiaceae | Devosia |
| 454 | Bacteria | Proteobacteria | Gammaproteobacteria | Xanthomonadales | Xanthomonadaceae | Dokdonella |
| 455 | Bacteria | Actinobacteria | Acidimicrobiia | Acidimicrobiales | | |
| 456 | Bacteria | Actinobacteria | Actinobacteria | Actinomycetales | Nocardiaceae | Rhodococcus |
| 457 | Bacteria | Bacteroidetes | Cytophagia | Cytophagales | Cytophagaceae | Hymenobacter |
| 458 | Bacteria | Proteobacteria | Gammaproteobacteria | Pseudomonadales | Moraxellaceae | Acinetobacter |
| 459 | Bacteria | Proteobacteria | Gammaproteobacteria | Enterobacteriales | Enterobacteriaceae | Pantoea |
| 460 | Bacteria | Firmicutes | Bacilli | Bacillales | Bacillaceae | Bacillus |
| 461 | Bacteria | Actinobacteria | Actinobacteria | Actinomycetales | Kineosporiaceae | Kineosporia |
| 462 | Bacteria | Firmicutes | Bacilli | Bacillales | Paenibacillaceae | Paenibacillus |
| 463 | Bacteria | TM6 | SJA-4 | | | |
| 464 | Bacteria | Proteobacteria | Alphaproteobacteria | Rhizobiales | Hyphomicrobiaceae | Rhodoplanes |
| 465 | Bacteria | Proteobacteria | Alphaproteobacteria | Caulobacterales | Caulobacteraceae | Brevundimonas |
| 466 | Bacteria | Proteobacteria | Gammaproteobacteria | Pseudomonadales | Pseudomonadaceae | Pseudomonas |
| 467 | Bacteria | Actinobacteria | Actinobacteria | Actinomycetales | Micromonosporaceae | |
| 468 | Bacteria | Proteobacteria | Alphaproteobacteria | Sphingomonadales | Sphingomonadaceae | Sphingomonas |
| 469 | Bacteria | Bacteroidetes | Cytophagia | Cytophagales | Cytophagaceae | |
| 470 | Bacteria | Proteobacteria | Gammaproteobacteria | Xanthomonadales | Xanthomonadaceae | Lysobacter |
| 471 | Bacteria | Proteobacteria | Alphaproteobacteria | Rhodospirillales | Acetobacteraceae | |
| 472 | Bacteria | Proteobacteria | Betaproteobacteria | | | |
| 473 | Bacteria | Actinobacteria | Actinobacteria | Actinomycetales | Nocardioidaceae | |
| 474 | Bacteria | Proteobacteria | Betaproteobacteria | Burkholderiales | Alcaligenaceae | Alcaligenes |
| 475 | Bacteria | Proteobacteria | Gammaproteobacteria | Pseudomonadales | Pseudomonadaceae | Pseudomonas |
| 476 | Bacteria | Proteobacteria | Deltaproteobacteria | Bdellovibrionales | Bdellovibrionaceae | Bdellovibrio |
| 477 | Bacteria | Firmicutes | Bacilli | Lactobacillales | Enterococcaceae | Enterococcus |
| 478 | Bacteria | Acidobacteria | Acidobacteria-6 | iii1-15 | | |
| 479 | Bacteria | Proteobacteria | Gammaproteobacteria | Pseudomonadales | Pseudomonadaceae | Pseudomonas |
| 480 | Bacteria | Proteobacteria | Alphaproteobacteria | Rhodobacterales | Rhodobacteraceae | Rhodobacter |
| 481 | Bacteria | Proteobacteria | Gammaproteobacteria | Pseudomonadales | Pseudomonadaceae | Pseudomonas |
| 482 | Bacteria | Proteobacteria | Betaproteobacteria | Burkholderiales | Comamonadaceae | unclassified |
| 483 | Bacteria | Actinobacteria | Actinobacteria | Actinomycetales | Thermomonosporaceae | Actinomadura |
| 484 | Bacteria | Proteobacteria | Gammaproteobacteria | Alteromonadales | 211ds20 | |
| 485 | Bacteria | Proteobacteria | Gammaproteobacteria | Pseudomonadales | Pseudomonadaceae | Pseudomonas |
| 486 | Bacteria | Proteobacteria | Betaproteobacteria | Burkholderiales | Comamonadaceae | unclassified |
| 487 | Bacteria | Actinobacteria | Actinobacteria | Actinomycetales | Micrococcaceae | Micrococcus |
| 488 | Bacteria | Bacteroidetes | Cytophagia | Cytophagales | Cytophagaceae | Dyadobacter |
| 489 | Bacteria | Proteobacteria | Alphaproteobacteria | Sphingomonadales | Sphingomonadaceae | Sphingomonas |
| 490 | Bacteria | Firmicutes | Bacilli | Bacillales | unclassified | unclassified |
| 491 | Bacteria | Proteobacteria | Gammaproteobacteria | Xanthomonadales | Xanthomonadaceae | Stenotrophomonas |
| 492 | Bacteria | Verrucomicrobia | [Spartobacteria] | [Chthoniobacterales] | [Chthoniobacteraceae] | DA101 |
| 493 | Bacteria | Proteobacteria | Alphaproteobacteria | Rhizobiales | Rhizobiaceae | Agrobacterium |
| 494 | Bacteria | Proteobacteria | Betaproteobacteria | Burkholderiales | Oxalobacteraceae | Janthinobacterium |
| 495 | Bacteria | Firmicutes | Bacilli | Bacillales | Paenibacillaceae | Paenibacillus |
| 496 | Bacteria | Bacteroidetes | Cytophagia | Cytophagales | Cytophagaceae | Hymenobacter |
| 497 | Bacteria | Firmicutes | Clostridia | Clostridiales | Clostridiaceae | Thermoanaerobacterium |
| 498 | Bacteria | Firmicutes | Bacilli | Bacillales | Bacillaceae | Bacillus |
| 499 | Bacteria | Proteobacteria | Betaproteobacteria | Burkholderiales | Comamonadaceae | unclassified |
| 500 | Bacteria | Proteobacteria | Alphaproteobacteria | Rhizobiales | Hyphomicrobiaceae | Rhodoplanes |
| 501 | Bacteria | Actinobacteria | Actinobacteria | Actinomycetales | Williamsiaceae | Williamsia |
| 502 | Bacteria | Actinobacteria | Actinobacteria | Actinomycetales | unclassified | unclassified |
| 503 | Bacteria | Firmicutes | Bacilli | Lactobacillales | Leuconostocaceae | Leuconostoc |
| 504 | Bacteria | Proteobacteria | Betaproteobacteria | Burkholderiales | Burkholderiaceae | Burkholderia |
| 505 | Bacteria | Proteobacteria | Alphaproteobacteria | Rickettsiales | | |
| 506 | Bacteria | Proteobacteria | Gammaproteobacteria | Pseudomonadales | Pseudomonadaceae | Pseudomonas |
| 507 | Bacteria | Bacteroidetes | Cytophagia | Cytophagales | Flammeovirgaceae | unclassified |
| 508 | Bacteria | Actinobacteria | Actinobacteria | Actinomycetales | Nocardioidaceae | |
| 509 | Bacteria | Bacteroidetes | Cytophagia | Cytophagales | Cytophagaceae | Dyadobacter |
| 510 | Bacteria | Proteobacteria | Alphaproteobacteria | Sphingomonadales | Sphingomonadaceae | Sphingomonas |
| 511 | Bacteria | Proteobacteria | Alphaproteobacteria | Rhodobacterales | Rhodobacteraceae | Paracoccus |
| 512 | Bacteria | Firmicutes | Clostridia | Clostridiales | [Tissierellaceae] | Finegoldia |
| 513 | Bacteria | Bacteroidetes | Sphingobacteriia | Sphingobacteriales | Sphingobacteriaceae | Pedobacter |
| 514 | Bacteria | Proteobacteria | Gammaproteobacteria | Pseudomonadales | Pseudomonadaceae | Pseudomonas |
| 515 | Bacteria | Proteobacteria | Alphaproteobacteria | Sphingomonadales | Sphingomonadaceae | Sphingomonas |
| 516 | Bacteria | Actinobacteria | Actinobacteria | Actinomycetales | Pseudonocardiaceae | Actinomycetospora |
| 517 | Bacteria | Actinobacteria | Actinobacteria | Actinomycetales | Microbacteriaceae | unclassified |
| 518 | Bacteria | Proteobacteria | Gammaproteobacteria | Enterobacteriales | Enterobacteriaceae | Erwinia |
| 519 | Bacteria | Proteobacteria | Gammaproteobacteria | Pseudomonadales | Pseudomonadaceae | |
| 520 | Bacteria | Proteobacteria | Alphaproteobacteria | Rhizobiales | Hyphomicrobiaceae | Devosia |
| 521 | Bacteria | Proteobacteria | Alphaproteobacteria | Sphingomonadales | Sphingomonadaceae | Kaistobacter |
| 522 | Bacteria | Proteobacteria | Alphaproteobacteria | Rhizobiales | Bradyrhizobiaceae | Bosea |
| 523 | Bacteria | Actinobacteria | Actinobacteria | Actinomycetales | Microbacteriaceae | unclassified |
| 524 | Bacteria | Actinobacteria | Actinobacteria | Actinomycetales | Promicromonosporaceae | Cellulosimicrobium |
| 525 | Bacteria | Proteobacteria | Alphaproteobacteria | Rhodospirillales | Rhodospirillaceae | Skermanella |

TABLE 1-continued

Bacterial endophytes contemplated as useful as component bacteria for the designed complex endophytes of the present invention

| SEQ ID NO | Kingdom | Phylum | Class | Order | Family | Genus |
|---|---|---|---|---|---|---|
| 526 | Bacteria | Proteobacteria | Deltaproteobacteria | Myxococcales | | |
| 527 | Bacteria | Actinobacteria | Actinobacteria | Actinomycetales | Micrococcaceae | *Arthrobacter* |
| 528 | Bacteria | Proteobacteria | Betaproteobacteria | Burkholderiales | Burkholderiaceae | *Burkholderia* |
| 529 | Bacteria | Firmicutes | Bacilli | Lactobacillales | Carnobacteriaceae | *Carnobacterium* |
| 530 | Bacteria | Proteobacteria | Alphaproteobacteria | Sphingomonadales | Sphingomonadaceae | *Sphingomonas* |
| 531 | Bacteria | Bacteroidetes | Cytophagia | Cytophagales | Cytophagaceae | *Hymenobacter* |
| 532 | Bacteria | Actinobacteria | Actinobacteria | Actinomycetales | Streptomycetaceae | *Streptomyces* |
| 533 | Bacteria | Bacteroidetes | Cytophagia | Cytophagales | Cytophagaceae | *Hymenobacter* |
| 534 | Bacteria | Proteobacteria | Gammaproteobacteria | Pseudomonadales | Pseudomonadaceae | *Pseudomonas* |
| 535 | Bacteria | Proteobacteria | Betaproteobacteria | Methylophilales | Methylophilaceae | |
| 536 | Bacteria | Proteobacteria | Gammaproteobacteria | Pseudomonadales | Moraxellaceae | *Alkanindiges* |
| 537 | Bacteria | Verrucomicrobia | [Spartobacteria] | [Chthoniobacterales] | [Chthoniobacteraceae] | DA101 |
| 538 | Bacteria | Bacteroidetes | Flavobacteriia | Flavobacteriales | Flavobacteriaceae | *Flavobacterium* |
| 539 | Bacteria | Proteobacteria | Betaproteobacteria | Burkholderiales | Comamonadaceae | unclassified |
| 540 | Bacteria | Proteobacteria | Alphaproteobacteria | Rhodospirillales | Acetobacteraceae | |
| 541 | Bacteria | Actinobacteria | Actinobacteria | Actinomycetales | Nocardioidaceae | |
| 542 | Bacteria | Proteobacteria | Betaproteobacteria | Burkholderiales | Oxalobacteraceae | *Janthinobacterium* |
| 543 | Bacteria | Actinobacteria | Actinobacteria | Actinomycetales | Kineosporiaceae | |
| 544 | Bacteria | Proteobacteria | Betaproteobacteria | Burkholderiales | Oxalobacteraceae | unclassified |
| 545 | Bacteria | Verrucomicrobia | Opitutae | Opitutales | Opitutaceae | *Opitutus* |
| 546 | Bacteria | Proteobacteria | Alphaproteobacteria | Sphingomonadales | Sphingomonadaceae | *Sphingomonas* |
| 547 | Bacteria | Firmicutes | Bacilli | Bacillales | Paenibacillaceae | *Paenibacillus* |
| 548 | Bacteria | Proteobacteria | Gammaproteobacteria | Enterobacteriales | Enterobacteriaceae | *Pantoea* |
| 549 | Bacteria | Proteobacteria | Gammaproteobacteria | Xanthomonadales | Xanthomonadaceae | *Luteibacter* |
| 550 | Bacteria | Bacteria | Actinobacteria | Actinobacteria | Actinomycetales | *Streptomycetaceae* |
| 551 | Bacteria | Bacteria | Actinobacteria | Actinobacteria | Actinomycetales | *Streptomycetaceae* |
| 552 | Bacteria | Bacteria | Actinobacteria | Actinobacteria | Actinomycetales | *Streptomycetaceae* |
| 553 | Bacteria | Bacteria | Actinobacteria | Actinobacteria | Actinomycetales | *Streptomycetaceae* |
| 554 | Bacteria | Bacteria | Actinobacteria | Actinobacteria | Actinomycetales | *Streptomycetaceae* |
| 555 | Bacteria | Bacteria | Actinobacteria | Actinobacteria | Actinomycetales | *Streptomycetaceae* |
| 556 | Bacteria | Bacteria | Actinobacteria | Actinobacteria | Actinomycetales | *Streptomycetaceae* |
| 557 | Bacteria | Bacteria | Actinobacteria | Actinobacteria | Actinomycetales | *Streptomycetaceae* |
| 558 | Bacteria | Bacteria | Actinobacteria | Actinobacteria | Actinomycetales | *Streptomycetaceae* |
| 559 | Bacteria | Bacteria | Actinobacteria | Actinobacteria | Actinomycetales | *Streptomycetaceae* |
| 560 | Bacteria | Bacteria | Actinobacteria | Actinobacteria | Actinomycetales | *Streptomycetaceae* |

TABLE 2

Fungal endophytes contemplated as useful as fungal hosts for the designed complex endophytes of the present invention

| SEQ ID NO | Kingdom | Phylum | Class | Order | Family | Genus |
|---|---|---|---|---|---|---|
| 561 | Fungi | Ascomycota | Pezizomycotina | Sordariomycetes | Xylariomycetidae | *Pestalotiopsis* |
| 562 | Fungi | Ascomycota | Eurotiomycetes | Chaetothyriales | Herpotrichiellaceae | *Phaeomoniella* |
| 563 | Fungi | Ascomycota | Sordariomycetes | Sordariomycetes | Xylariomycetidae | *Biscogniauxia* |
| 564 | Fungi | Ascomycota | Eurotiomycetes | Chaetothyriales | Herpotrichiellaceae | *Phaeomoniella* |
| 565 | Fungi | Ascomycota | Sordariomycetes | Sordariomycetes unidentified | Sordariomycetes unidentified | *Sordariomycetes* unidentified |
| 566 | Fungi | Ascomycota | Eurotiomycetes | Chaetothyriales | Chaetothyriales unidentified | *Chaetothyriales* unidentified |
| 567 | Fungi | Ascomycota | Dothideomycetes | Pleosporales | Incertae sedis | *Phoma* |
| 568 | Fungi | Ascomycota | Dothideomycetes | Pleosporales | Pleosporaceae | *Alternaria* |
| 569 | Fungi | Ascomycota | Dothideomycetes | Dothideales | Dothioraceae | *Aureobasidium* |
| 570 | Fungi | Ascomycota | Sordariomycetes | Coniochaetales | Coniochaetaceae | *Lecythophora* |
| 571 | Fungi | Ascomycota | Dothideomycetes | Dothideales | Dothioraceae | *Hormonema* |
| 572 | Fungi | Ascomycota | Dothideomycetes | Pleosporales | Sporormiaceae | *Preussia* |
| 573 | Fungi | Ascomycota | Sordariomycetes | Coniochaetales | Coniochaetaceae | *Lecythophora* |
| 574 | Fungi | Ascomycota | Dothideomycetes | Incertae sedis | Incertae sedis | *Monodictys* |
| 575 | Fungi | Ascomycota | Sordariomycetes | Xylariales | Amphisphaeriaceae | *Pestalotiopsis* |
| 576 | Fungi | Ascomycota | Dothideomycetes | Capnodiales | Mycosphaerellaceae | *Cladosporium* |
| 577 | Fungi | Ascomycota | Dothideomycetes | Botryosphaeriales | Botryosphaeriaceae | *Botryosphaeria* |
| 578 | Fungi | Ascomycota | Dothideomycetes | Botryosphaeriales | Botryosphaeriaceae | *Phyllosticta* |
| 579 | Fungi | Ascomycota | Dothideomycetes | Pleosporales | Montagnulaceae | *Paraconiothyrium* |
| 580 | Fungi | Ascomycota | Sordariomycetes | Xylariales | Amphisphaeriaceae | *Pestalotiopsis* |
| 581 | Fungi | Ascomycota | Dothideomycetes | Pleosporales | Montagnulaceae | *Paraconiothyrium* |
| 582 | Fungi | Ascomycota | Eurotiomycetes | Eurotiales | Trichocomaceae | *Penicillium* |
| 583 | Fungi | Ascomycota | Sordariomycetes | Xylariales | Xylariaceae | *Xylariaceae* unidentified |
| 584 | Fungi | Ascomycota | Sordariomycetes | Xylariales | Xylariaceae | *Xylariaceae* unidentified |
| 585 | Fungi | Ascomycota | Sordariomycetes | Sordariomycetes unidentified | Sordariomycetes unidentified | *Sordariomycetes* unidentified |
| 586 | Fungi | Ascomycota | Sordariomycetes | Xylariales | Xylariaceae | *Xylariaceae* unidentified |
| 587 | Fungi | Ascomycota | Sordariomycetes | Xylariales | Xylariaceae | *Xylariaceae* unidentified |

TABLE 2-continued

Fungal endophytes contemplated as useful as fungal hosts for the designed complex endophytes of the present invention

| SEQ ID NO | Kingdom | Phylum | Class | Order | Family | Genus |
|---|---|---|---|---|---|---|
| 588 | Fungi | Ascomycota | Sordariomycetes | Hypocreales | Nectriaceae | *Fusarium* |
| 589 | Fungi | Ascomycota | Sordariomycetes | Hypocreales | Nectriaceae | *Fusarium* |
| 590 | Fungi | Ascomycota | Sordariomycetes | Hypocreales | Nectriaceae | *Fusarium* |
| 591 | Fungi | Ascomycota | Sordariomycetes | Hypocreales | Nectriaceae | *Nectria* |
| 592 | Fungi | Ascomycota | Sordariomycetes | Hypocreales | Nectriaceae | *Fusarium* |
| 593 | Fungi | Ascomycota | Sordariomycetes | Xylariales | Xylariaceae | *Xylaria* |
| 594 | Fungi | Ascomycota | Sordariomycetes | Xylariales | Xylariaceae | *Hypoxylon* |
| 595 | Fungi | Ascomycota | Sordariomycetes | Hypocreales | Nectriaceae | *Fusarium* |
| 596 | Fungi | Ascomycota | Sordariomycetes | Xylariales | Xylariaceae | *Xylaria* |
| 597 | Fungi | Ascomycota | Sordariomycetes | Xylariales | Xylariaceae | *Xylaria* |
| 598 | Fungi | Ascomycota | Sordariomycetes | Hypocreales | Nectriaceae | *Fusarium* |
| 599 | Fungi | Ascomycota | Dothideomycetes | Pleosporales | Sporormiaceae | *Preussia* |
| 600 | Fungi | Ascomycota | Dothideomycetes | Pleosporales | Sporormiaceae | *Preussia* |
| 601 | Fungi | Ascomycota | Dothideomycetes | Pleosporales | Sporormiaceae | *Preussia* |
| 602 | Fungi | Ascomycota | Sordariomycetes | Hypocreales | Nectriaceae | *Fusarium* |
| 603 | Fungi | Ascomycota | Sordariomycetes | Hypocreales | Nectriaceae | *Fusarium* |
| 604 | Fungi | Ascomycota | Sordariomycetes | Hypocreales | Nectriaceae | *Fusarium* |
| 605 | Fungi | Ascomycota | Dothideomycetes | Pleosporales | Sporormiaceae | *Preussia* |
| 606 | Fungi | Ascomycota | Dothideomycetes | Pleosporales | Montagnulaceae | *Paraconiothyrium* |
| 607 | Fungi | Ascomycota | Dothideomycetes | Pleosporales | Montagnulaceae | *Paraconiothyrium* |
| 608 | Fungi | Ascomycota | Dothideomycetes | Pleosporales | Pleosporales unidentified | *Pleosporales* unidentified |
| 609 | Fungi | Ascomycota | Sordariomycetes | Coniochaetales | Coniochaetaceae | *Lecythophora* |
| 610 | Fungi | Ascomycota | Dothideomycetes | Pleosporales | Incertae sedis | *Phoma* |
| 611 | Fungi | Ascomycota | Sordariomycetes | Sordariales | Sordariaceae | *Neurospora* |
| 612 | Fungi | Ascomycota | Dothideomycetes | Dothideomycetes unidentified | Dothideomycetes unidentified | *Dothideomycetes* unidentified |
| 613 | Fungi | Ascomycota | Dothideomycetes | Capnodiales | Davidiellaceae | *Cladosporium* |
| 614 | Fungi | Ascomycota | Dothideomycetes | Pleosporales | Sporormiaceae | *Preussia* |
| 615 | Fungi | Ascomycota | Dothideomycetes | Capnodiales | Davidiellaceae | *Cladosporium* |
| 616 | Fungi | Ascomycota | Dothideomycetes | Pleosporales | Pleosporales Incertae sedis | *Periconia* |
| 617 | Fungi | Ascomycota | Dothideomycetes | Pleosporales | Pleosporales Incertae sedis | *Periconia* |
| 618 | Fungi | Ascomycota | Dothideomycetes | Pleosporales | Pleosporaceae | *Alternaria* |
| 619 | Fungi | Ascomycota | Dothideomycetes | Pleosporales | Pleosporales Incertae sedis | *Periconia* |
| 620 | Fungi | Ascomycota | Dothideomycetes | Pleosporales | Pleosporaceae | *Alternaria* |
| 621 | Fungi | Ascomycota | Dothideomycetes | Pleosporales | Pleosporales Incertae sedis | *Periconia* |
| 622 | Fungi | Ascomycota | Dothideomycetes | Capnodiales | Davidiellaceae | *Cladosporium* |
| 623 | Fungi | Ascomycota | Dothideomycetes | Dothideales | Dothideales unidentified | *Dothideales* unidentified |
| 624 | Fungi | Ascomycota | Dothideomycetes | Pleosporales | Leptosphaeriaceae | *Coniothyrium* |
| 625 | Fungi | Ascomycota | Dothideomycetes | Pleosporales | Pleosporaceae | *Alternaria* |
| 626 | Fungi | Ascomycota | Dothideomycetes | Pleosporales | Pleosporaceae | *Alternaria* |
| 627 | Fungi | Ascomycota | Dothideomycetes | Pleosporales | Pleosporales Incertae sedis | *Periconia* |
| 628 | Fungi | Ascomycota | Dothideomycetes | Pleosporales | Pleosporales Incertae sedis | *Periconia* |
| 629 | Fungi | Ascomycota | Dothideomycetes | Capnodiales | Davidiellaceae | *Cladosporium* |
| 630 | Fungi | Ascomycota | Dothideomycetes | Pleosporales | Pleosporaceae | *Alternaria* |
| 631 | Fungi | Ascomycota | Dothideomycetes | Pleosporales | Pleosporales Incertae sedis | *Periconia* |
| 632 | Fungi | Ascomycota | Dothideomycetes | Pleosporales | Sporormiaceae | *Preussia* |
| 633 | Fungi | Ascomycota | Dothideomycetes | Pleosporales | Sporormiaceae | *Sporormiaceae* unidentified |
| 634 | Fungi | Ascomycota | Dothideomycetes | Pleosporales | Sporormiaceae | *Preussia* |
| 635 | Fungi | Ascomycota | Dothideomycetes | Pleosporales | Sporormiaceae | *Preussia* |
| 636 | Fungi | Ascomycota | Dothideomycetes | Pleosporales | Pleosporaceae | *Alternaria* |
| 637 | Fungi | unclassified | unclassified | unclassified | unclassified | unclassified |
| 638 | Fungi | unclassified | unclassified | unclassified | unclassified | unclassified |
| 639 | Fungi | unclassified | unclassified | unclassified | unclassified | unclassified |
| 640 | Fungi | Ascomycota | Sordariomycetes | Hypocreales | Nectriaceae | *Fusarium* |
| 641 | Fungi | Ascomycota | Dothideomycetes | Pleosporales | Pleosporaceae | *Lewia* |
| 642 | Fungi | Basidiomycota | unclassified | unclassified | unclassified | unclassified |
| 643 | Fungi | Zygomycota | Incertae sedis | Mucorales | Rhizopodaceae | *Rhizopus* |
| 644 | Fungi | Ascomycota | Saccharomycetes | Saccharomycetales | Pichiaceae | *Pichia* |
| 645 | Fungi | Ascomycota | Dothideomycetes | Capnodiales | Mycosphaerellaceae | unidentified |
| 646 | Fungi | Ascomycota | Eurotiomycetes | Eurotiales | Trichocomaceae | *Aspergillus* |
| 647 | Fungi | unclassified | unclassified | unclassified | unclassified | unclassified |
| 648 | Fungi | Ascomycota | Dothideomycetes | Capnodiales | Davidiellaceae | *Davidiella* |
| 649 | Fungi | Ascomycota | Leotiomycetes | Helotiales | Helotiaceae | unclassified |
| 650 | Fungi | Ascomycota | Sordariomycetes | Hypocreales | Nectriaceae | *Fusarium* |
| 651 | Fungi | Ascomycota | Dothideomycetes | Pleosporales | Incertae sedis | *Phoma* |
| 652 | Fungi | Ascomycota | Eurotiomycetes | Eurotiales | Trichocomaceae | *Penicillium* |
| 653 | Fungi | Ascomycota | Sordariomycetes | Hypocreales | Nectriaceae | *Gibberella* |
| 654 | Fungi | Ascomycota | Eurotiomycetes | Eurotiales | Trichocomaceae | *Penicillium* |
| 655 | Fungi | Ascomycota | Dothideomycetes | Pleosporales | Incertae sedis | *Phoma* |
| 656 | Fungi | Basidiomycota | Tremellomycetes | Cystofilobasidiales | Cystofilobasidiaceae | *Udeniomyces* |
| 657 | Fungi | Ascomycota | Dothideomycetes | Pleosporales | Phaeosphaeriaceae | unclassified |
| 658 | Fungi | Ascomycota | Dothideomycetes | Pleosporales | Phaeosphaeriaceae | unidentified |
| 659 | Fungi | Ascomycota | Dothideomycetes | Pleosporales | Pleosporaceae | *Epicoccum* |
| 660 | Fungi | Ascomycota | Dothideomycetes | Pleosporales | Pleosporaceae | *Cochliobolus* |
| 661 | Fungi | Ascomycota | Sordariomycetes | Hypocreales | Nectriaceae | *Gibberella* |

TABLE 2-continued

Fungal endophytes contemplated as useful as fungal hosts for the designed complex endophytes of the present invention

| SEQ ID NO | Kingdom | Phylum | Class | Order | Family | Genus |
|---|---|---|---|---|---|---|
| 662 | Fungi | Ascomycota | Sordariomycetes | Hypocreales | Incertae sedis | *Acremonium* |
| 663 | Fungi | Ascomycota | Dothideomycetes | Pleosporales | Pleosporaceae | *Lewia* |
| 664 | Fungi | Ascomycota | Eurotiomycetes | Eurotiales | Trichocomaceae | unidentified |
| 665 | Fungi | Basidiomycota | Tremellomycetes | unidentified | unidentified | unidentified |
| 666 | Fungi | Ascomycota | Dothideomycetes | Capnodiales | Davidiellaceae | *Cladosporium* |
| 667 | Fungi | Ascomycota | unclassified | unclassified | unclassified | unclassified |
| 668 | Fungi | unclassified | unclassified | unclassified | unclassified | unclassified |
| 669 | Fungi | Ascomycota | Dothideomycetes | Pleosporales | Incertae sedis | *Phoma* |
| 670 | Fungi | Ascomycota | Sordariomycetes | Xylariales | Incertae sedis | *Monographella* |
| 671 | Fungi | Ascomycota | Dothideomycetes | Pleosporales | Phaeosphaeriaceae | unidentified |
| 672 | Fungi | unclassified | unclassified | unclassified | unclassified | unclassified |
| 673 | Fungi | Ascomycota | Dothideomycetes | Pleosporales | Pleosporaceae | unclassified |
| 674 | Fungi | Basidiomycota | unclassified | unclassified | unclassified | unclassified |
| 675 | Fungi | unclassified | unclassified | unclassified | unclassified | unclassified |
| 676 | Fungi | Ascomycota | Leotiomycetes | Erysiphales | Erysiphaceae | *Erysiphe* |
| 677 | Fungi | Ascomycota | Sordariomycetes | Hypocreales | Nectriaceae | *Gibberella* |
| 678 | Fungi | Basidiomycota | Wallemiomycetes | Wallemiales | Wallemiaceae | *Wallemia* |
| 679 | Fungi | Basidiomycota | Microbotryomycetes | Sporidiobolales | Incertae sedis | *Sporobolomyces* |
| 680 | Fungi | Ascomycota | Eurotiomycetes | Eurotiales | Trichocomaceae | *Penicillium* |
| 681 | Fungi | Ascomycota | Eurotiomycetes | Eurotiales | Trichocomaceae | *Aspergillus* |
| 682 | Fungi | Ascomycota | Dothideomycetes | Dothideales | Dothioraceae | unidentified |
| 683 | Fungi | Basidiomycota | unclassified | unclassified | unclassified | unclassified |
| 684 | Fungi | Ascomycota | Dothideomycetes | Capnodiales | Davidiellaceae | *Cladosporium* |
| 685 | Fungi | Ascomycota | Dothideomycetes | Pleosporales | Pleosporaceae | unclassified |
| 686 | Fungi | Basidiomycota | Tremellomycetes | Tremellales | Incertae sedis | *Cryptococcus* |
| 687 | Fungi | Basidiomycota | Tremellomycetes | Filobasidiales | Filobasidiaceae | *Cryptococcus* |
| 688 | Fungi | Ascomycota | Dothideomycetes | Pleosporales | Phaeosphaeriaceae | *Parastagonospora* |
| 689 | Fungi | Ascomycota | Eurotiomycetes | Eurotiales | Trichocomaceae | *Penicillium* |
| 690 | Fungi | unclassified | unclassified | unclassified | unclassified | unclassified |
| 691 | Fungi | Basidiomycota | Tremellomycetes | Filobasidiales | Filobasidiaceae | *Cryptococcus* |
| 692 | Fungi | Ascomycota | Dothideomycetes | Capnodiales | Davidiellaceae | *Cladosporium* |
| 693 | Fungi | Basidiomycota | Tremellomycetes | Filobasidiales | Filobasidiaceae | *Cryptococcus* |
| 694 | Fungi | Ascomycota | Dothideomycetes | Capnodiales | Davidiellaceae | *Cladosporium* |
| 695 | Fungi | Basidiomycota | Tremellomycetes | Filobasidiales | Filobasidiaceae | *Cryptococcus* |
| 696 | Fungi | Basidiomycota | Tremellomycetes | Tremellales | Incertae sedis | *Hannaella* |
| 697 | Fungi | Ascomycota | Dothideomycetes | unclassified | unclassified | unclassified |
| 698 | Fungi | Basidiomycota | Microbotryomycetes | Sporidiobolales | Incertae sedis | *Rhodosporidium* |
| 699 | Fungi | Ascomycota | Dothideomycetes | Pleosporales | Phaeosphaeriaceae | unidentified |
| 700 | Fungi | Ascomycota | Dothideomycetes | Pleosporales | Phaeosphaeriaceae | unclassified |
| 701 | Fungi | Basidiomycota | Microbotryomycetes | Sporidiobolales | Incertae sedis | *Sporobolomyces* |
| 702 | Fungi | Ascomycota | Dothideomycetes | Pleosporales | Leptosphaeriaceae | unidentified |
| 703 | Fungi | Basidiomycota | Microbotryomycetes | Sporidiobolales | Incertae sedis | *Sporobolomyces* |
| 704 | Fungi | unclassified | unclassified | unclassified | unclassified | unclassified |
| 705 | Fungi | Ascomycota | Leotiomycetes | Helotiales | Sclerotiniaceae | *Botrytis* |
| 706 | Fungi | Basidiomycota | Wallemiomycetes | Wallemiales | Wallemiaceae | *Wallemia* |
| 707 | Fungi | Basidiomycota | Wallemiomycetes | Wallemiales | Wallemiaceae | *Wallemia* |
| 708 | Fungi | Basidiomycota | Tremellomycetes | unidentified | unidentified | unidentified |
| 709 | Fungi | Ascomycota | Dothideomycetes | Capnodiales | Mycosphaerellaceae | *Cercospora* |
| 710 | Fungi | Ascomycota | Dothideomycetes | Pleosporales | Incertae sedis | *Phoma* |
| 711 | Fungi | Ascomycota | Dothideomycetes | Pleosporales | Incertae sedis | *Phoma* |
| 712 | Fungi | Basidiomycota | Tremellomycetes | Tremellales | Incertae sedis | *Hannaella* |
| 713 | Fungi | Basidiomycota | Wallemiomycetes | Wallemiales | Wallemiaceae | *Wallemia* |
| 714 | Fungi | Basidiomycota | Tremellomycetes | unidentified | unidentified | unidentified |
| 715 | Fungi | Ascomycota | Dothideomycetes | Pleosporales | Phaeosphaeriaceae | unidentified |
| 716 | Fungi | Ascomycota | Dothideomycetes | Pleosporales | Phaeosphaeriaceae | *Stagonospora* |
| 717 | Fungi | Basidiomycota | Tremellomycetes | Tremellales | Incertae sedis | *Bullera* |
| 718 | Fungi | Basidiomycota | Tremellomycetes | Tremellales | Incertae sedis | unidentified |
| 719 | Fungi | Basidiomycota | Tremellomycetes | Tremellales | Incertae sedis | *Cryptococcus* |
| 720 | Fungi | Basidiomycota | Tremellomycetes | Filobasidiales | Filobasidiaceae | *Cryptococcus* |
| 721 | Fungi | Basidiomycota | Tremellomycetes | Filobasidiales | Filobasidiaceae | *Cryptococcus* |
| 722 | Fungi | Basidiomycota | Tremellomycetes | Tremellales | Incertae sedis | *Cryptococcus* unclassified |
| 723 | Fungi | Ascomycota | Dothideomycetes | Pleosporales | unclassified | unclassified |
| 724 | Fungi | Basidiomycota | Tremellomycetes | Tremellales | Incertae sedis | *Cryptococcus* |
| 725 | Fungi | unclassified | unclassified | unclassified | unclassified | unclassified |
| 726 | Fungi | Basidiomycota | Tremellomycetes | Tremellales | Incertae sedis | unidentified |
| 727 | Fungi | Basidiomycota | unclassified | unclassified | unclassified | unclassified |
| 728 | Fungi | Ascomycota | Dothideomycetes | Pleosporales | Incertae sedis | *Phoma* |
| 729 | Fungi | Basidiomycota | Tremellomycetes | Filobasidiales | Filobasidiaceae | *Cryptococcus* |
| 730 | Fungi | Basidiomycota | Tremellomycetes | Tremellales | Incertae sedis | *Cryptococcus* |
| 731 | Fungi | Basidiomycota | Microbotryomycetes | Sporidiobolales | Incertae sedis | *Sporobolomyces* |
| 732 | Fungi | unclassified | unclassified | unclassified | unclassified | unclassified |
| 733 | Fungi | Ascomycota | Dothideomycetes | Pleosporales | Phaeosphaeriaceae | unclassified |
| 734 | Fungi | Ascomycota | Sordariomycetes | Hypocreales | Incertae sedis | *Acremonium* |
| 735 | Fungi | Basidiomycota | unclassified | unclassified | unclassified | unclassified |
| 736 | Fungi | unclassified | unclassified | unclassified | unclassified | unclassified |

TABLE 2-continued

Fungal endophytes contemplated as useful as fungal hosts for the designed complex endophytes of the present invention

| SEQ ID NO | Kingdom | Phylum | Class | Order | Family | Genus |
|---|---|---|---|---|---|---|
| 737 | Fungi | Basidiomycota | Tremellomycetes | Tremellales | Incertae sedis | *Cryptococcus* |
| 738 | Fungi | unclassified | unclassified | unclassified | unclassified | unclassified |
| 739 | Fungi | Ascomycota | Dothideomycetes | Pleosporales | unclassified | unclassified |
| 740 | Fungi | Basidiomycota | Tremellomycetes | Tremellales | Incertae sedis | *Hannaella* |
| 741 | Fungi | Basidiomycota | Microbotryomycetes | Sporidiobolales | Incertae sedis | *Sporobolomyces* |
| 742 | Fungi | Ascomycota | Dothideomycetes | Incertae sedis | Incertae sedis | *Leptospora* |
| 743 | Fungi | Ascomycota | Dothideomycetes | Pleosporales | Leptosphaeriaceae | unidentified |
| 744 | Fungi | Ascomycota | Eurotiomycetes | Eurotiales | Trichocomaceae | *Aspergillus* |
| 745 | Fungi | Basidiomycota | Tremellomycetes | Tremellales | Incertae sedis | *Dioszegia* |
| 746 | Fungi | Basidiomycota | Tremellomycetes | Tremellales | unidentified | unidentified |
| 747 | Fungi | Basidiomycota | Microbotryomycetes | Sporidiobolales | Incertae sedis | *Sporobolomyces* |
| 748 | Fungi | Ascomycota | Dothideomycetes | Pleosporales | Incertae sedis | *Phoma* |
| 749 | Fungi | Basidiomycota | Tremellomycetes | Filobasidiales | Filobasidiaceae | *Cryptococcus* |
| 750 | Fungi | Basidiomycota | Tremellomycetes | Tremellales | Incertae sedis | *Cryptococcus* |
| 751 | Fungi | Ascomycota | Dothideomycetes | Pleosporales | Leptosphaeriaceae | unidentified |
| 752 | Fungi | Basidiomycota | Tremellomycetes | Tremellales | Incertae sedis | *Dioszegia* |
| 753 | Fungi | Basidiomycota | Tremellomycetes | Tremellales | unidentified | unidentified |
| 754 | Fungi | Basidiomycota | Tremellomycetes | Tremellales | Incertae sedis | *Bullera* |
| 755 | Fungi | Basidiomycota | Cystobasidiomycetes | Erythrobasidiales | Incertae sedis | *Erythrobasidium* |
| 756 | Fungi | Zygomycota | Mucoromycotina | Mucorales | Mucoraceae | *Mucor* |
| 757 | Fungi | Ascomycota | Dothideomycetes | Capnodiales | Davidiellaceae | *Cladosporium* |
| 758 | Fungi | Ascomycota | Sordariomycetes | Xylariales | Amphisphaeriaceae | *Pestalotiopsis* |

TABLE 3

Isolated complex endophytes, designed complex endophytes, bacterial components, and fungal hosts utilized in the present invention Endophytes and endophytic components utilized to demonstrate the present invention include:

Isolated complex endophytes: F(B)
Fungal endophyte confirmed to not be a complex endophyte, not comprising bacteria: F( )
Cured isolated complex endophytes and other fungal endophytes, all treated with antibiotics according to the Examples section and confirmed to be free of component bacteria: F(B−)
Isolated and purified bacteria: B
Designed complex endophytes, each comprising a fungal host and a component bacterium, synthesized from the methods described in the present invention: F(B*)

| ID | Type | Genus (F) | Genus (B) |
|---|---|---|---|
| SYM15779_native | F(B) | *Mucor* | *Pantoea* |
| SYM15890_native | F( ) | *Cladosporium* | N/A |
| SYM166_native | F(B) | *Pestalotiopsis* | *Luteibacter* |
| SYM15779_cured | F(B−) | *Mucor* | |
| SYM15890_cured | F(B−) | *Cladosporium* | |
| SYM166_cured (SYM16670) | F(B−) | *Pestalotiopsis* | |
| SYM257 | B | | *Streptomyces* |
| SYM292_bacterium only | B | | *Paenibacillus* |
| EHB15779_bacterium only | B | | *Pantoea* |
| EHB166_bacterium only (SYM16660) | B | | *Luteibacter* |
| 15579 + EHB15779 | F(B*) | *Mucor* | *Pantoea* |
| 15779 + 292 | F(B*) | *Mucor* | *Paenibacillus* |
| 15779 + EHB166 | F(B*) | *Mucor* | *Luteibacter* |
| 166 + 257 | F(B*) | *Pestalotiopsis* | *Streptomyces* |

TABLE 4

Plant vigor assays: wheat normal watering conditions

| | Wheat No Stress | | |
|---|---|---|---|
| Treatment | Average root length (cm) | Average shoot length (cm) | Average total seedling mass (g) |
| Formulation | 10.92 | 5.72 | 1.9 |
| SYM 292 | 10.80 | 6.03 | 1.7 |
| EHB 15779 | 20.44 | 6.35 | 2 |
| SYM 15779 Cured | 9.63 | 4.76 | 1.5 |
| SYM 15779 + 15779 | 10.27 | 5.03 | 1.9 |
| SYM 15779 + 15779 | 8.10 | 6.19 | 1.7 |
| SYM 15579 + 292 | 11.48 | 5.93 | 1.8 |
| SYM 15579 + 292 | 10.27 | 4.92 | 1.9 |
| SYM 15779 + EHB166 | 9.84 | 4.82 | 1.8 |

TABLE 5

Plant vigor assay: wheat drought (water-limited/water-stressed) conditions

| | Wheat Water Stress | | |
|---|---|---|---|
| Treatment | Average root length (cm) | Average shoot length (cm) | Average total seedling mass (g) |
| Formulation | 3.86 | 0.85 | 0.7 |
| SYM 292 | 2.62 | 0.81 | 0.5 |
| EHB 15779 | 7.41 | 5.24 | 1.4 |
| SYM 15779 Cured | 5.02 | 2.48 | 0.8 |
| SYM 15779 + 15779 | 7.39 | 4.45 | 1.4 |
| SYM 15779 + 15779 | 5.27 | 3.87 | 1.3 |
| SYM 15579 + 292 | 6.61 | 4.76 | 1.5 |
| SYM 15779 + 292 | 4.64 | 1.59 | 0.7 |
| SYM 15779 + EHB166 | 4.00 | 1.33 | 0.7 |

TABLE 6

Plant vigor assay: soybean normal watering conditions

| Treatment | Soybean No Stress Average Root Surface Area (cm^2) | Average total seedling mass (g) |
|---|---|---|
| Formulation | 1.49 | 3.60 |
| SYM 292 | 2.19 | 5.69 |
| EHB 15779 | 2.39 | 5.16 |
| SYM 15579 Cured | 2.44 | 5.11 |
| SYM 15779 + 15779 | 2.57 | 5.16 |
| SYM 15779 + 15779 | 2.54 | 5.20 |
| SYM 15779 + 292 | 2.60 | 4.73 |
| SYM 15779 + 292 | 1.99 | 5.40 |
| SYM 15779 + EHB166 | 3.32 | 5.24 |

TABLE 7

Plant vigor assay data summary

Table 7a: Effects of adding bacteria to a fungal host, on plant health parameters for seeds treated with complex endophytes and/or their components. For example, adding the bacterium EHB15779 as an endofungal bacterial component to the host fungus 15779 results in improved root length under normal watering conditions for wheat plants grown from seeds treated with the designed complex endophyte, as compared to plants grown under the same condition from seeds treated with just the fungal endophyte.

| Crop | Condition | Expt | 15779 F( ) EHB15779 | EHB15779 | B292 | B292 | EHB166 |
|---|---|---|---|---|---|---|---|
| Wheat | Normal watering | root length | + | − | − | + | + |
| | | shoot length | + | + | + | − | − |
| | | seedling mass | + | + | + | + | + |
| | Water-limited | root length | + | + | − | + | ○ |
| | | shoot length | + | + | − | + | ○ |
| | | seedling mass | + | + | − | + | + |
| Soy | Normal watering | root surface area | + | + | + | + | + |
| | | seedling mass | + | + | − | + | + |

Table 7b: Effects of adding a fungal host to a bacterium, on plant health parameters for seeds treated with complex endophytes and/or their components. In another example, adding a fungal host 15779 to the bacterium EHB166 so that it becomes an endofungal complex endophyte decreases the shoot length under normal watering conditions of wheat plants grown from seeds treated with said designed complex endophyte, as compared to plants grown under the same condition from seeds treated with just the bacterial endophyte.

| Crop | Condition | Expt | EHB15779 F15779 | B292 F15779 | F15779 |
|---|---|---|---|---|---|
| Wheat | Normal watering | root length | − | + | − |
| | | shoot length | + | ○ | − |
| | | seedling mass | + | + | + |
| | Water-limited | root length | − | + | + |
| | | shoot length | − | + | + |
| | | seedling mass | − | + | + |
| Soy | Normal watering | root surface area | − | + | − |
| | | seedling mass | − | − | − |

Table 7c: Comparison of the performance of each designed complex endophyte and the improvement over performance of individual components. For example, the designed complex endophyte 15779 + EHB15779 displays improved root length for wheat plants grown under water-limited conditions as compared to the root length of wheat plants grown under the same condition from seeds treated with only the fungal endophyte component. In another example, the designed complex endophyte 15779 + 292 displays improved seedling mass for wheat plants grown under normal watering conditions as compared to the seedling mass of wheat plants grown under the same condition from seeds treated with only the fungal endophyte component or only the bacterial endophyte component.

| Crop | Condition | Expt | 15779 + EHB15779 | 15779 + EHB15779 | 15779 + 292 | 15779 + 292 | 15779 + 166* |
|---|---|---|---|---|---|---|---|
| Wheat | Normal watering | root length | F | | F, B | F | F |
| | | shoot length | F | F, B | | | |
| | | seedling mass | F | F, B | F, B | F, B | F |

TABLE 7-continued

Plant vigor assay data summary

|     |                |                  |      |   |      |      |   |
|-----|----------------|------------------|------|---|------|------|---|
|     | Water-limited  | root length      | F    | F | B    | F, B |   |
|     |                | shoot length     | F    | F | F, B | F, B | F |
|     |                | seedling mass    | F    | F | F, B | F, B | F |
| Soy | Normal watering| root surface area| F, B | F | F, B | F    | F |
|     |                | seedling mass    | F, B | F |      | F    | F |

(Note:
The "*" next to 166 denotes that no comparison was possible vs. plants treated with only the bacterial 166 component, as no seeds were treated with just 166 bacterial endophyte. Comparison results are therefore given vs. the fungal endophyte component alone.)

REFERENCES

Amann et al. (2001) Current Opinion in Biotechnology 12:231-236
Bensch et al, "The genus *Cladosporium*" in: Studies in Mycology 72:1-401. 2012 doi:10.3114/sim0003
Couper and Eley, J. Polymer Sci., 3: 345-349 (1948)
Craine et al., Nature Climate Change 3: 63-67 (2013)
Crous and Groenveld, 2006
Desirò et al. (2014 ISME J. 8: 257-270
Edgar R C, 2004
Gao, Zhan, et al. Journal of clinical microbiology 48.10 (2010): 3575-3581
Hallman et al., (1997) Canadian Journal of Microbiology. 43(10): 895-914)
Hardegree and Emmerich (Plant Physiol., 92, 462-466 (1990)
Hawksworth, 2012
Hodgson Am. Potato. J. 38: 259-264 (1961)
Hoffman and Arnold, 2010 Appl. Environ. Microbiol. 76: 4063-4075
Hoffman et al., 2013 PLOS One 8: e73132
International Code of Nomenclature for Algae, Fungi, and Plants (Melbourne Code)
International Botanical Congress (2012)
Johnston-Monje D, Raizada M N (2011) PLoS ONE 6(6): e20396
Jung and Arnold, 2012 The Effects of Endohyphal Bacteria on Anti-Cancer and Anti-Malaria Metabolites of Endophytic Fungi, Honors Thesis, University of Arizona
Kwasna 2003
Long et al., 2010, New Phytologist 185: 554-567
Lundberg et al., (2012) Nature. 488, 86-90
Marquez et al., 2007 Science 315: 513-515
Michel and Kaufmann (Plant Physiol., 51: 914-916 (1973)
Pearson, 1990, Methods Enzymol. 183:63-98, incorporated herein by reference in its entirety
Perez-Fernandez et al. [J. Environ. Biol. 27: 669-685 (2006)
Sambrook, Joseph, Edward F. Fritsch, and Thomas Maniatis. Molecular cloning. Vol. 2. New York: Cold spring harbor laboratory press, 1989
Shenoy, 2007
Summerbell, 2011
Taylor, 2011
Zhang and Qiu, 2015
U.S. Pat. No. 7,485,451
EP 0818135
CA 1229497
WO 2013090628
EP 0192342
WO 2008103422
CA 1041788

SEQUENCE LISTING (758 sequences)

SEQ ID NO: 1 - DNA, 1336 bp, Unknown
  Kingdom: Bacteria, Phylum: Firmicutes, Class: Bacilli, Order: Bacillales, Family: Bacillaceae , Genus: Bacillus
agcttgctccctgatgttagcggcggacgggtgagtaacacgtgggtaacctgcctgtaagactgggataactccgggaaaccggggctaataccggatgcttgtttaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctcttctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacacccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgagaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcaca

SEQ ID NO: 2 - DNA, 1295 bp, Unknown
  Kingdom: Bacteria, Phylum: Firmicutes, Class: Bacilli, Order: Bacillales, Family: Bacillaceae , Genus: Bacillus
gaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgag

SEQ ID NO: 3 - DNA, 1337 bp, Unknown
  Kingdom: Bacteria, Phylum: Firmicutes, Class: Bacilli, Order: Bacillales, Family: Bacillaceae , Genus: Bacillus
agcttgctccctgatgttagcggcggacgggtgagtaacacgtgggtaacctgcctgtaagactgggataactccgggaaaccggggctaataccggatggttgtttaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcaca

SEQ ID NO: 4 - DNA, 1338 bp, Unknown
  Kingdom: Bacteria, Phylum: Firmicutes, Class: Bacilli, Order: Bacillales, Family: Paenibacillaceae , Genus: Paenibacillus
agcttgcttctccgatggttagcggcggacgggtgagtaacacgtaggcaacctgccctcaagtttgggacaactaccggaaacggtagctaataccgaatagttgtttttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcaca

SEQ ID NO: 5 - DNA, 1338 bp, Unknown; identical to SEQ ID NO: 4
  Kingdom: Bacteria, Phylum: Firmicutes, Class: Bacilli, Order: Bacillales, Family: Paenibacillaceae , Genus: Paenibacillus

SEQ ID NO: 6 - DNA, 1326 bp, Unknown
  Kingdom: Bacteria, Phylum: Proteobacteria, Class: Gammaproteobacteria, Order: Pseudomonadales, Family: Moraxellaceae, Genus: Acinetobacter
agcttgctacttgacctagcggcggacgggcgaagtaatgcttaggaatctgcctattagtgggggacaacgtctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaagcctgatccagccatgccgcgtgtgtgaagaaggccttttggttgtaaagcactttaagcgaggaggaggctaccgagattaatactcttggatagtggacgttactcgcaaaataagcaccggctaactctgtgccagcagccgcggtaaatacagagggtgcaagcgttaatcggatttactgggcgtaaagcgcgcgtaggtggcttattaagtcgaatgtgaaatccccgagcttaacttgggaattgcattcaatactggttggctagagtatgggagaggatggtaaattccaggtgtacggtgaaatgcgtaagatctggaggaataccgatggcgaaggcagccatctggcctaatactgacctgaggtgcgaaagctggggagcaaacaggattagataccctggtagtccatgccgtacacgatgtctactagccgttggggcctttgaggctttagtggcgcagctaacgcgataagtagaccgcctggggagtacggtcgcaagactaaaactcaaatgaattgacgggggcccgcaccagcggtggagcatgtggtttaattcgatgcaacgcgaagaaccttacctggccttgacatagtaagaactttccagagatggattggtgccttcgggaacttacatacaggtgctgcatggcggtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacggccagggctacacacgtgctacaatggtcggtacaaagggttgccacctcgcgagaggatgctaatctcaaaaagccgatcgtagtccggatcgcagtctgcaactcgactccgtgaagtcggaatcgctagtaatcgcggatcagaatgccgcggtgaatacgttcccgggccttgtacacaccgcccgtcaca

SEQ ID NO: 7 - DNA, 1409 bp, Unknown
  Kingdom: Bacteria, Phylum: Proteobacteria, Class: Betaproteobacteria, Order: Burkholderiales, Family: Burkholderiaceae, Genus: Burkholderia
ggtgaccgtcctccttgcggttagactagccacttctggtaaaacccactcccatggtgtgacgggcggtgtgtacaagacccgggaacgtattcaccgcggcatgctgatccgcgattactagcgattccagcttcacgcacccgagttgcagagtgcgatccggactacgatcggttttctgggattggctccacctcgcggcttggcgaccctctgttccgaccattgtatgacgtgtgaagccctacccataagggccatgaggacttgacgtcatccccaccttcctccggtttgtcaccggcagtctccctggagtgctcttgcgtagcaactagggacaagggttgcgctcgttgcgggacttaacccaacatctcacgacacgagctgacgacagccatgcagcacctgtgtatcggttccctttcgggcactcccacctctcagcaggattccgaccatgtcaagggtaggtaaggtttttcgcgttgcatcgaattaatccacatcatccaccgcttgtgcgggtccccgtcaattcctttgagttttaatcttgcgaccgtactccccaggcggtcaacttcacgcgttagctacgttaccaagccaatgaaggcccgacaaccagttgacatcgtttagggcgtggactaccagggtatctaatcctgtttgctccscacgctttcgtgcatgagcgtcagtattggcccagggggctgccttcgccatcggtattcctccacatctctacgcatttcactgctacacgtggaattctacccccctctgccatactctagcccgccagtcacaaatgcagttcccaggttaagcccggggatttcacatctgtcttagcgaaccgcctgcgcacgctttacgcccagtaattccgattaacgcttgcaccctacgtattaccgcggctgctggcacgtagttagccggtgcttattcttccggtaccgtcatcccccacgggtattaaccacgaggttttctttccggacaaaagtgctttacaacccgaaggccttcttcacacacgcggcattgctggatcaggcttgcgcccattgtccaaaattccccactgctgcctcccgtaggagtctgggccgtgtctcagtcccagtgtggctggtcgtcctctcagaccagctacagatcgtcgccttggtaggcctttaccccaccaactagctaatctgccatcggccgccccttgagcgagaggtccgaagatccccccctttcctccacagagcgtatgcggtattaatccggctttcgccgggctatcccccactccaggacacgttccgatgtattactcacccgttcgccactcgccaccagggttgcccccgtgctgccgttcgactgcatgttaagtc

SEQ ID NO: 8 - DNA, 1281 bp, Unknown
  Kingdom: Bacteria, Phylum: Proteobacteria, Class: Alphaproteobacteria, Order: Sphingomonadales, Family: Sphingomonadaceae, Genus: Sphingomonas
ttcggggtctagtggcgcacgggtgcgtaacgcgtgggaatctgcccttgggttcggaataacagttggaaacgactgctaataccggatgatgacgtaagtccaaagatttattgcccagggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaatcccgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcaca

SEQ ID NO: 9 - DNA, 1333 bp, Unknown
  Kingdom: Bacteria, Phylum: Proteobacteria, Class: Gammaproteobacteria, Order: Xanthomonadales, Family: Xanthomonadaceae, Genus: Luteibacter
agcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcaca

SEQ ID NO: 10 - DNA, 1295 bp, Unknown
  Kingdom: Bacteria, Phylum: Proteobacteria, Class: Alphaproteobacteria, Order: Sphingomonadales, Family: Sphingomonadaceae, Genus: Sphingomonas
cttcgggtctagtggcgcacgggtgcgtaacgcgtgggaatctgcccttgggttcggaataacagttggaaacgactgctaataccggatgatgacgtaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaatcccgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgga

SEQ ID NO: 11 - DNA, 1369 bp, Unknown
  Kingdom: Bacteria, Phylum: Firmicutes, Class: Bacilli, Order: Bacillales, Family: Paenibacillaceae , Genus: Paenibacillus
gcttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggt

SEQ ID NO: 12 - DNA, 1366 bp, Unknown
  Kingdom: Bacteria, Phylum: Firmicutes, Class: Bacilli, Order: Bacillales, Family: Paenibacillaceae , Genus: Paenibacillus
gcttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtc

SEQ ID NO: 13 - DNA, 1303 bp, Unknown
  Kingdom: Bacteria, Phylum: Firmicutes, Class: Bacilli, Order: Bacillales, Family: Paenibacillaceae , Genus: Paenibacillus
ggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgccc

SEQ ID NO: 14 - DNA, 1313 bp, Unknown
  Kingdom: Bacteria, Phylum: Proteobacteria, Class: Betaproteobacteria, Order: Burkholderiales, Family: Burkholderiaceae, Genus: Ralstonia
gattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctccggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagagggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtggagctggaatcgctagtaatcgcggatcagcatgccgcggtgaatacgttcccgggtcttgtacacaccgcccgtc

SEQ ID NO: 15 - DNA, 1337 bp, Unknown
  Kingdom: Bacteria, Phylum: Firmicutes, Class: Bacilli, Order: Bacillales, Family: Bacillaceae , Genus: Bacillus
tgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccatcgagagtt

SEQ ID NO: 16 - DNA, 1326 bp, Unknown
  Kingdom: Bacteria, Phylum: Proteobacteria, Class: Betaproteobacteria, Order: Burkholderiales, Family: Burkholderiaceae, Genus: Ralstonia
agcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaggaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcaca

SEQ ID NO: 17 - DNA, 1368 bp, Unknown
  Kingdom: Bacteria, Phylum: Firmicutes, Class: Bacilli, Order: Bacillales, Family: Paenibacillaceae , Genus: Paenibacillus
cttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggt

SEQ ID NO: 18 - DNA, 1368 bp, Unknown
  Kingdom: Bacteria, Phylum: Firmicutes, Class: Bacilli, Order: Bacillales, Family: Paenibacillaceae , Genus: Paenibacillus
gcttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcgg

SEQ ID NO: 19 - DNA, 1371 bp, Unknown
  Kingdom: Bacteria, Phylum: Firmicutes, Class: Bacilli, Order: Bacillales, Family: Paenibacillaceae , Genus: Paenibacillus
gcttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtgg

SEQ ID NO: 20 - DNA, 1350 bp, Unknown
  Kingdom: Bacteria, Phylum: Firmicutes, Class: Bacilli, Order: Bacillales, Family: Bacillaceae , Genus: Bacillus
  misc_feature (1207)..(1207): n is a, c, g, or t
ttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtaaagatgtggaggaacaccagtggcggtaactgacgttgaggagcgaaagcgtggggagcgaacaggattagataccctggtagtccacgccgtaaacgatgagtgctaagtgttagggggtttccgccccttagtgctgcagctaacgcattaagcactccgcctggggtgtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcngttcggatcgcagtctgcaactcgactgcgtgaagctggaatcgctagtaatcgcggatcagcatgccgcggtgaatacgttcccgggccttgtacacaccgcccgtcacaccacgagagttttaacacccgaagtcggtgag

SEQ ID NO: 21 - DNA, 1366 bp, Unknown
  Kingdom: Bacteria, Phylum: Firmicutes, Class: Bacilli, Order: Bacillales, Family: Paenibacillaceae , Genus: Paenibacillus
gcttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtatacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtc

SEQ ID NO: 22 - DNA, 1368 bp, Unknown; identical to SEQ ID NO: 17
  Kingdom: Bacteria, Phylum: Firmicutes, Class: Bacilli, Order: Bacillales, Family: Paenibacillaceae , Genus: Paenibacillus

SEQ ID NO: 23 - DNA, 1367 bp, Unknown
  Kingdom: Bacteria, Phylum: Firmicutes, Class: Bacilli, Order: Bacillales, Family: Paenibacillaceae , Genus: Paenibacillus
gcttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcg

SEQ ID NO: 24 - DNA, 1367 bp, Unknown
  Kingdom: Bacteria, Phylum: Firmicutes, Class: Bacilli, Order: Bacillales, Family: Paenibacillaceae , Genus: Paenibacillus
ttgcttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggt

SEQ ID NO: 25 - DNA, 1363 bp, Unknown
  Kingdom: Bacteria, Phylum: Firmicutes, Class: Bacilli, Order: Bacillales, Family: Paenibacillaceae , Genus: Paenibacillus
ttctccgatggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggt

SEQ ID NO: 26 - DNA, 1371 bp, Unknown; identical to SEQ ID NO: 19
  Kingdom: Bacteria, Phylum: Firmicutes, Class: Bacilli, Order: Bacillales, Family: Paenibacillaceae , Genus: Paenibacillus

SEQ ID NO: 27 - DNA, 1324 bp, Unknown
  Kingdom: Bacteria, Phylum: Proteobacteria, Class: Betaproteobacteria, Order: Burkholderiales, Family: Oxalobacteraceae, Genus: Massilia
gcggggcaacctggcggcgagtggcgaacgggtgagtaatatatcggaacgtacccagaagtgggggataacgtagcgaaagttacgctaataccgcatacgatctacggatgaaagtgggggaccttcgggcctcatgcttttggagcggccgatatctgattagctagttggtgaggtaaaggctcaccaaggcgacgatcagtagctggtctgagaggacgaccagccacactgggactgagacacggcccagactcctacgggaggcagcagtggggaattttggacaatgggcgcaagcctgatccagcaatgccgcgtgagtgaagaaggccttcgggttgtaaagctcttttgtcagggaagaaacggcctgggttaataccttgggctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggcttaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtcaggaagcctggagagatccgggtgtgcccgaaagggaacctgaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctagtaatcgcggatcagcatgccgcggtgaatacgttcccgggtcttgtacacaccgcccgtcaca

SEQ ID NO: 28 - DNA, 1353 bp, Unknown
  Kingdom: Bacteria, Phylum: Proteobacteria, Class: Betaproteobacteria, Order: Burkholderiales, Family: Oxalobacteraceae, Genus: Massilia
cctggcggcgagtggcgaacgggtgagtaatatatcggaacgtacccagaagtgggggataacgtagcgaaagttacgctaataccgcatacgatctacggatgaaagtgggggaccttcgggcctcatgcttttggagcggccgatatctgattagctagttggtgaggtaaaggctcaccaaggcgacgatcagtagctggtctgagaggacgaccagccacactgggactgagacacggcccagactcctacgggaggcagcagtggggaattttggacaatgggcgcaagcctgatccagcaatgccgcgtgagtgaagaaggccttcgggttgtaaagctcttttgtcagggaagaaacggcctgggttaataccttgggctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggcttaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtcaggaagcctggagagatccgggtgtgcccgaaagggaacctgaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctagtaatcgcggatcagcatgccgcggtgaatacgttcccgggtcttgtacacaccgcccgtcacaccatgggagcgggttataccagaagtaggtagctaacc

SEQ ID NO: 29 - DNA, 1317 bp, Unknown
  Kingdom: Bacteria, Phylum: Proteobacteria, Class: Betaproteobacteria, Order: Burkholderiales, Family: Burkholderiaceae, Genus: Ralstonia
gattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaaccggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgcgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcaca

SEQ ID NO: 30 - DNA, 1326 bp, Unknown
  Kingdom: Bacteria, Phylum: Proteobacteria, Class: Gammaproteobacteria, Order: Pseudomonadales, Family: Moraxellaceae, Genus: Acinetobacter
ttgctacattacctaacggcggacgggtgagtaatgcttaggaatctgcctattagtgggagacaacattccgaaaggaatgctaatactgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctactagtattaatactactggatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacggcgtcaagtcatcatggcccttacgtccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcaca

SEQ ID NO: 31 - DNA, 1333 bp, Unknown; identical to SEQ ID NO: 9
  Kingdom: Bacteria, Phylum: Proteobacteria, Class: Gammaproteobacteria, Order: Xanthomonadales, Family: Xanthomonadaceae, Genus: Luteibacter

SEQ ID NO: 32 - DNA, 1296 bp, Unknown
  Kingdom: Bacteria, Phylum: Proteobacteria, Class: Betaproteobacteria, Order: Burkholderiales, Family: Comamonadaceae, Genus: Variovorax
gtgagtaatacatcggaacgtgcccaatcgtgggggataacgcagcgaaagctgtgctaataccgcatacgatctacggatgaaagcaggggaccgcaaggccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagcaatgccgcgtgcaggatgaaggccttcgggttgtaaactgcttttgtacggaacgaaacggttctttctaataaagagagctaatgacggtaccgtaagaataagcaccggctaactacgtgccagcagccgcggtaatacgtagggtgcaagcgttaatcggaattactgggcgtaaagcgtgcgcaggcggttatgtaagacagttgtgaaatccccgggctcaacctgggaattgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttaccagagatggtttagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcac

SEQ ID NO: 33 - DNA, 1317 bp, Unknown
  Kingdom: Bacteria, Phylum: Proteobacteria, Class: Betaproteobacteria, Order: Burkholderiales, Family: Burkholderiaceae, Genus: Ralstonia
gattgatggcgagtggcgaacgggtgagtaatacgtcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcaca

SEQ ID NO: 34 - DNA, 1369 bp, Unknown
  Kingdom: Bacteria, Phylum: Firmicutes, Class: Bacilli, Order: Bacillales, Family: Bacillaceae , Genus: Bacillus
agcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcgg

SEQ ID NO: 35 - DNA, 1376 bp, Unknown
  Kingdom: Bacteria, Phylum: Firmicutes, Class: Bacilli, Order: Bacillales, Family: Bacillaceae , Genus: Bacillus
gcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggaac

SEQ ID NO: 36 - DNA, 1386 bp, Unknown
  Kingdom: Bacteria, Phylum: Firmicutes, Class: Bacilli, Order: Bacillales, Family: Paenibacillaceae , Genus: Paenibacillus
  misc_feature (10)..(10): n is a, c, g, or t
  misc_feature (109)..(109): n is a, c, g, or t
  misc_feature (389)..(389): n is a, c, g, or t
  misc_feature (931)..(931): n is a, c, g, or t
  misc_feature (941)..(941): n is a, c, g, or t
  misc_feature (951)..(951): n is a, c, g, or t
gcttgcttcnctgatggttagcggcggacgggtgagtaacacgtaggcaacctgccctcaagcttgggacaactaccggaaacggtagctaataccgaatacttgcttncttcgcctgaagggagctggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccttnagagtaactgcttaaggagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctntgaccgtccnagagataggnctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaagagc

SEQ ID NO: 37 - DNA, 1212 bp, Unknown
  Kingdom: Bacteria, Phylum: Firmicutes, Class: Bacilli, Order: Bacillales, Family: Paenibacillaceae , Genus: Paenibacillus
gcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcactttgggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgg

SEQ ID NO: 38 - DNA, 1328 bp, Unknown
  Kingdom: Bacteria, Phylum: Proteobacteria, Class: Betaproteobacteria, Order: Burkholderiales, Family: Burkholderiaceae, Genus: Burkholderia
cctggtggcgagtggcgaacgggtgagtaatacatcggaacgtgtcctgtagtgggggatagcccggcgaaagccggattaataccgcatacgctctacggaggaaagggggggatcttaggacctctcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaaacttctgtcctaatacggcgggaggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggtcttcattgacttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaagtctgccgagaggtggatgtgcccgaaagggagccataacacaggtgctgcatggctgtcgtcagctcgtgtcgtgagatgttgggttaagtcccgcaacgagcgcaacccttgtccctagttgctacgcaagagcactccagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtggg

SEQ ID NO: 39 - DNA, 1377 bp, Unknown
  Kingdom: Bacteria, Phylum: Firmicutes, Class: Bacilli, Order: Bacillales, Family: Bacillaceae , Genus: Bacillus
agcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaa

SEQ ID NO: 40 - DNA, 1333 bp, Unknown; identical to SEQ ID NO: 9
  Kingdom: Bacteria, Phylum: Proteobacteria, Class: Gammaproteobacteria, Order: Xanthomonadales, Family: Xanthomonadaceae, Genus: Luteibacter

SEQ ID NO: 41 - DNA, 1317 bp, Unknown
  Kingdom: Bacteria, Phylum: Proteobacteria, Class: Betaproteobacteria, Order: Burkholderiales, Family: Burkholderiaceae, Genus: Ralstonia
gattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagggactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtctcgtacacaccgcccgtcaca

SEQ ID NO: 42 - DNA, 1258 bp, Unknown
  Kingdom: Bacteria, Phylum: Firmicutes, Class: Bacilli, Order: Bacillales, Family: Bacillaceae , Genus: Bacillus
ctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgtccc

SEQ ID NO: 43 - DNA, 1362 bp, Unknown
  Kingdom: Bacteria, Phylum: Actinobacteria, Class: Actinobacteria, Order: Actinomycetales, Family: Microbacteriaceae, Genus: Curtobacterium
agtcgacgatgatgcccagcttgctgggtggattagtggcgaacgggtgagtaacacgtgagtaacctgcccctgactctgggataagcgttggaaacgacgtctaatactggatatgatcgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtatacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggc

SEQ ID NO: 44 - DNA, 1284 bp, Unknown
  Kingdom: Bacteria, Phylum: Actinobacteria, Class: Actinobacteria, Order: Actinomycetales, Family: Microbacteriaceae, Genus: Curtobacterium
  misc_feature (53)..(53): n is a, c, g, or t
cttgctgggtggattagtggcgaacgggtgagtaacacgtgagtaacctgccnctgactctgggataagcgttggaaacgacgtctaatactggatatgatcgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttccc

SEQ ID NO: 45 - DNA, 1333 bp, Unknown
  Kingdom: Bacteria, Phylum: Proteobacteria, Class: Gammaproteobacteria, Order: Xanthomonadales, Family: Xanthomonadaceae, Genus: Luteibacter
agcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagcttgttggtgaggtaacggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcaca

SEQ ID NO: 46 - DNA, 1355 bp, Unknown
  Kingdom: Bacteria, Phylum: Proteobacteria, Class: Gammaproteobacteria, Order: Xanthomonadales, Family: Xanthomonadaceae, Genus: Luteibacter
cttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttccctggccttgtacacaccgcccgtcacaccatgggagtgagctgctccagaa

SEQ ID NO: 47 - DNA, 641 bp, Unknown
  Kingdom: Bacteria, Phylum: Proteobacteria, Class: Gammaproteobacteria, Order: Enterobacteriales, Family: Enterobacteriaceae, Genus: Pantoea
  misc_feature (333)..(333): n is a, c, g, or t
  misc_feature (344)..(345): n is a, c, g, or t
  misc_feature (351)..(352): n is a, c, g, or t
  misc_feature (619)..(619): n is a, c, g, or t
  misc_feature (626)..(626): n is a, c, g, or t
  misc_feature (635)..(635): n is a, c, g, or t
gtcgaagctaaattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacagttcccgaaggcactaangcatctctgcnnaattcnntggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccaccctcngtattancgcgggtgntggcag

SEQ ID NO: 48 - DNA, 1333 bp, Unknown; identical to SEQ ID NO: 45
  Kingdom: Bacteria, Phylum: Proteobacteria, Class: Gammaproteobacteria, Order: Xanthomonadales, Family: Xanthomonadaceae, Genus: Luteibacter

SEQ ID NO: 49 - DNA, 1374 bp, Unknown
  Kingdom: Bacteria, Phylum: Firmicutes, Class: Bacilli, Order: Bacillales, Family: Bacillaceae , Genus: Bacillus
cttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggaac

SEQ ID NO: 50 - DNA, 1322 bp, Unknown
  Kingdom: Bacteria, Phylum: Firmicutes, Class: Bacilli, Order: Bacillales, Family: Bacillaceae , Genus: Bacillus
  misc_feature (219)..(219): n is a, c, g, or t
  misc_feature (293)..(293): n is a, c, g, or t
  misc_feature (303)..(303): n is a, c, g, or t
  misc_feature (406)..(406): n is a, c, g, or t
  misc_feature (1152)..(1152): n is a, c, g, or t
atgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcntagccgacctgagagggtgatcggccacactgggactgagacacggcccagactcctacgggaggcagcagtanggaatcttcngcaatggacgaaagtctgacggagcaacgccgcgtgagtgatgaaggttttcggatcgtaaagctctgttgttagggaagaacaagtaccgttcgaatagggnggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggtcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacntgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggc

SEQ ID NO: 51 - DNA, 1368 bp, Unknown; identical to SEQ ID NO: 18
  Kingdom: Bacteria, Phylum: Firmicutes, Class: Bacilli, Order: Bacillales, Family: Paenibacillaceae , Genus: Paenibacillus

SEQ ID NO: 52 - DNA, 1371 bp, Unknown; identical to SEQ ID NO: 19
  Kingdom: Bacteria, Phylum: Firmicutes, Class: Bacilli, Order: Bacillales, Family: Paenibacillaceae , Genus: Paenibacillus

SEQ ID NO: 53 - DNA, 1374 bp, Unknown
  Kingdom: Bacteria, Phylum: Firmicutes, Class: Bacilli, Order: Bacillales, Family: Bacillaceae , Genus: Bacillus
cttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaa

SEQ ID NO: 54 - DNA, 1381 bp, Unknown
  Kingdom: Bacteria, Phylum: Firmicutes, Class: Bacilli, Order: Bacillales, Family: Bacillaceae , Genus: Bacillus
  misc_feature (106)..(106): n is a, c, g, or t
atgggagcttgctccctgatgttagcggcggacgggtgagtaacacgtgggtaacctgcctgtaagactgggataactccgggaaaccggggctaataccggatgnttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaa

SEQ ID NO: 55 - DNA, 1177 bp, Unknown
  Kingdom: Bacteria, Phylum: Proteobacteria, Class: Gammaproteobacteria, Order: Enterobacteriales, Family: Enterobacteriaceae, Genus: Pantoea
tgggggggtaaaggcccacttggggaggatcccagtttgtgtgaggggtgaccagcccaccggaaatgggacccggtcccgactcttacggagggagcagtgggaatattgcacaatgggcccaaccctgatgcagccatgccgggttatgaagaggcctttgggttgtaaagtactttcagcggggaggaaggcgatgcggttataaccgcaccgattgacgttacccgcagaagaagcacgggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcggcagagatgctttagtgccttcgggaactgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggtgcaaaagaagtagg

SEQ ID NO: 56 - DNA, 1345 bp, Unknown
  Kingdom: Bacteria, Phylum: Proteobacteria, Class: Alphaproteobacteria, Order: Rhizobiales, Family: Rhizobiaceae, Genus: Rhizobium
cagtcgagcgcatccttcggggtgagcggcagacgggtgagtaacgcgtgggaatctaccttttgctacggaatagctccgggaaactggaattaataccgtatgtgccctttggcggtggacgctggaggggaaagatttatcggcaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcactttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtccggctagctagagagatctagtgttcccttcggggaccggagcacaggtgctgcatggctgtcgtcagctcgtgtcgtgagatgttgggttaagtcccgcaacgagcgcaaccctcgcccttagttgccagcattaggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaa

SEQ ID NO: 57 - DNA, 707 bp, Unknown
  Kingdom: Bacteria, Phylum: Proteobacteria, Class: Gammaproteobacteria, Order: Enterobacteriales, Family: Enterobacteriaceae, Genus: Pantoea
  misc_feature (427)..(427): n is a, c, g, or t
  misc_feature (439)..(439): n is a, c, g, or t
  misc_feature (446)..(446): n is a, c, g, or t
gttagctacctacttcttttgcacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacagttcccgaaggcactaangcatctctgccnaattctntggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtcca

SEQ ID NO: 58 - DNA, 1333 bp, Unknown; identical to SEQ ID NO: 9
  Kingdom: Bacteria, Phylum: Proteobacteria, Class: Gammaproteobacteria, Order: Xanthomonadales, Family: Xanthomonadaceae, Genus: Luteibacter

SEQ ID NO: 59 - DNA, 1361 bp, Unknown
  Kingdom: Bacteria, Phylum: Proteobacteria, Class: Gammaproteobacteria, Order: Xanthomonadales, Family: Xanthomonadaceae, Genus: Luteibacter
ttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgtag

SEQ ID NO: 60 - DNA, 1360 bp, Unknown
  Kingdom: Bacteria, Phylum: Proteobacteria, Class: Gammaproteobacteria, Order: Xanthomonadales, Family: Xanthomonadaceae, Genus: Luteibacter
gcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccg

SEQ ID NO: 61 - DNA, 1357 bp, Unknown
  Kingdom: Bacteria, Phylum: Proteobacteria, Class: Gammaproteobacteria, Order: Xanthomonadales, Family: Xanthomonadaceae, Genus: Luteibacter
ttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagcc

SEQ ID NO: 62 - DNA, 1330 bp, Unknown
  Kingdom: Bacteria, Phylum: Proteobacteria, Class: Gammaproteobacteria, Order: Enterobacteriales, Family: Enterobacteriaceae, Genus: Erwinia
agcttgctcctcgggtgacgagtggcggacgggtgagtaatgtctggggatctgcccggtagagggggataaccactggaaacggtggctaataccgcataatctcgcaagagcaaagtgggggaccttcgggcctcacactaccggatgaacccagatgggattagccagctggtgaggtaacggctcaccagggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggtgaagagcgaataacttttcacattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacccgggaactgcatttgaaactggcaggcttgagtctcgtagaggggggtggaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgatttggaggctgtgagcttgactcgtggcttccgtagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacggaatcgggcagagatgcctgagtgccttcgggagccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggatcggagtctgcaacccgactccgtgaagtcggaatcgctagtaatcgtggatcagaatgccacggtgaatacgttcccgggccttgtacacaccgcccgtcaca

SEQ ID NO: 63 - DNA, 1253 bp, Unknown
  Kingdom: Bacteria, Phylum: Proteobacteria, Class: Gammaproteobacteria, Order: Xanthomonadales, Family: Xanthomonadaceae, Genus: Luteibacter
tacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttc

SEQ ID NO: 64 - DNA, 463 bp, Unknown
  Kingdom: Bacteria, Phylum: Proteobacteria, Class: Gammaproteobacteria, Order: Xanthomonadales, Family: Xanthomonadaceae, Genus: Luteibacter
atggaccgatgtgcgattagctagttggtaaggtaacggcttaccaaggcgacgatcgctagctggtctgagaggatgatcagccacactgggactgaacacggcccagactcctacgggaggcacagtggggaatattggacaatgggcgcaagcctgatccagcaatgccgcgtgtgtgaagaaggccctcgggttgtaaagcacttttatcaggagcgaaatctgcaaggttaatacctttgcatctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtg

SEQ ID NO: 65 - DNA, 1250 bp, Unknown
  Kingdom: Bacteria, Phylum: Proteobacteria, Class: Gammaproteobacteria, Order: Xanthomonadales, Family: Xanthomonadaceae, Genus: Luteibacter
tacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacg

SEQ ID NO: 66 - DNA, 1254 bp, Unknown
  Kingdom: Bacteria, Phylum: Proteobacteria, Class: Gammaproteobacteria, Order: Xanthomonadales, Family: Xanthomonadaceae, Genus: Luteibacter
tacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcc

SEQ ID NO: 67 - DNA, 1295 bp, Unknown
  Kingdom: Bacteria, Phylum: Proteobacteria, Class: Gammaproteobacteria, Order: Xanthomonadales, Family: Xanthomonadaceae, Genus: Luteibacter
gggtggcgagtggcggacgggtgagtaatgcatcgggacatacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttccc

SEQ ID NO: 68 - DNA, 1364 bp, Unknown
  Kingdom: Bacteria, Phylum: Proteobacteria, Class: Gammaproteobacteria, Order: Xanthomonadales, Family: Xanthomonadaceae, Genus: Luteibacter
cttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagt

SEQ ID NO: 69 - DNA, 1356 bp, Unknown
  Kingdom: Bacteria, Phylum: Proteobacteria, Class: Gammaproteobacteria, Order: Enterobacteriales, Family: Enterobacteriaceae, Genus: Erwinia
cttgctcctcgggtgacgagtggcggacgggtgagtaatgtctggggatctgcccggtagagggggataaccactggaaacggtggctaataccgcataatctcgcaagagcaaagtgggggaccttcgggcctcacactaccggatgaacccagatgggattagccagctggtgaggtaacggctcaccagggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggtgaagagcgaataacttttcacattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacccgggaactgcatttgaaactggcaggcttgagtctcgtagaggggggtggaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgatttggaggctgtgagcttgactcgtggcttccgtagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacggaatcgggcagagatgcctgagtgccttcgggagccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggatcggagtctgcaacccgactccgtgaagtcggaatcgctagtaatcgtggatcagaatgccacggtgaatacgttcccgggccttgtacacaccgcccgtcacaccatgggagtgggttgcaaaagaagtag

SEQ ID NO: 70 - DNA, 1326 bp, Unknown
  Kingdom: Bacteria, Phylum: Proteobacteria, Class: Betaproteobacteria, Order: Burkholderiales, Family: Burkholderiaceae, Genus: Ralstonia
agcttgctacattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcactagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaacaaccttacctacccttgacatgccactaacgaagcagagatgcattacgtgctcgaaagagaaagcggacacaggtgctgcatggctgtcgtcagctcgtgtcgtgagatgttgggttaagtcccgcaacgagcgcaacccttgtctgtagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcaca

SEQ ID NO: 71 - DNA, 1394 bp, Unknown
  Kingdom: Bacteria, Phylum: Proteobacteria, Class: Gammaproteobacteria, Order: Pseudomonadales, Family: Pseudomonadaceae, Genus: Pseudomonas
  misc_feature (1384)..(1384): n is a, c, g, or t
agtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagccaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttagggaactctgacacaggtgctgcatggctgtcgtcagctcgtgtcgtgagatgttgggttaagtcccgcaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaancttcgggagg

SEQ ID NO: 72 - DNA, 1344 bp, Unknown
  Kingdom: Bacteria, Phylum: Proteobacteria, Class: Alphaproteobacteria, Order: Caulobacterales, Family: Caulobacteraceae, Genus: Caulobacter
ggctgcctccttgcggttagcacaccgtcttcgggtaaagccaactcccatggtgtgacgggcggtgtgtacaaggcccgggaacgtattcaccgcggcatgctgatccgcgattactagcgattccaacttcatgcactcgagttgcagagtgcaatccgaactgagacgacttttagggattggctccccctcgcgggattgcagccctctgtagtcgccattgtagcacgtgtgtagcccaccctgtaagggccatgaggacttgacgtcatccccaccttcctccggcttaccaccggcggtcctgttagagtgcccagccaaacctggtagcaactaacagcgagggttgcgctcgttgcgggacttaacccaacatctcacgacacgagctgacgacagctatgcagcacctgtgtcccagtccccgaagggaaagccacatctctgtggcggtccgggcatgtcaaaaggtggtaaggttctgcgcgttgcttcgaattaaaccacatgctccaccgcttgtgcgggcccccgtcaattcctttgagttttaatcttgcgaccgtactccccaggcggagtgcttaatgcgttagctgcgtcaccgacatgcatgcatgccgacaactagcactcatcgtttacggcgtggactaccagggtatctaatcctgtttgctccccacgctttcgcgcctcagcgtcagtaacgggccagtgagtcgccttcgccactggtgttcttccgaatatctacgaatttcacctctacactcggagttccactcacctctcccgtactcaagacagccagtattgaaggcatttccgaggttgagccccgggctttcacccccaacttaactgtccgcctacgcgccctttacgcccagtaattccgagcaacgctagcccccttcgtattaccgcggctgctggcacgaagttagccggggcttcttctccgggtaccgtcattatcgtccacggtgaaaggattttacaatcctaagaccttcatcatccacgcggcatggctgcgtcaggctttcgcccattgcgcaagattccccactgctgcctcccgtaggagtctgggccgtgtctcagtcccagtgtggctggccatcctctcagaccagctactgatcgtagccttggtgagccattacctcaccaacaagctaatcagacgcgggccgctccaaaggcgataaatctttcccccgaagggcttatccggtattagcacaagtttccctgtgttgttccgaacctaagggtacgttcccacgtgttactcacccgtccgccactatcccgaaggaccgttcgact

SEQ ID NO: 73 - DNA, 1344 bp, Unknown
  Kingdom: Bacteria, Phylum: Proteobacteria, Class: Alphaproteobacteria, Order: Caulobacterales, Family: Caulobacteraceae, Genus: Caulobacter
ggctgcctccttgcggttagcacaccgtcttcgggtaaagccaactcccatggtgtgacgggcggtgtgtacaaggcccgggaacgtattcaccgcggcatgctgatccgcgattactagcgattccaacttcatgcactcgagttgcagagtgcaatccgaactgagacgacttttagggattggctccccctcgcgggattgcagccctctgtagtcgccattgtagcacgtgtgtagcccaccctgtaagggccatgaggacttgacgtcatccccaccttcctccggcttaccaccggcggtcctgttagagtgcccagccaaacctggtagcaactaacagcgagggttgcgctcgttgcgggacttaacccaacatctcacgacacgagctgacgacagccatgcagcacctgtgtcccagtccccgaagggaaagccacatctctgtggcggtccgggcatgtcaaaaggtggtaaggttctgcgcgttgcttcgaattaaaccacatgctccaccgcttgtgcgggcccccgtcaattcctttgagttttaatcttgcgaccgtactccccaggcggagtgcttaatgcgttagctgcgtcaccgacatgcatgcatgccgacaactagcactcatcgtttacggcgtggactaccagggtatctaatcctgtttgctccccacgctttcgcgcctcagcgtcagtaacgggccagtgagtcgccttcgccactggtgttcttccgaatatctacgaatttcacctctacactcggagttccactcacctctcccgtactcaagacagccagtattgaaggcatttccgaggttgagccccgggctttcacccccaacttaactgtccgcctacgcgccctttacgcccagtaattccgagcaacgctagcccccttcgtattaccgcggctgctggcacgaagttagccggggcttcttctccgggtaccgtcattatcgtccccggtgaaaggattttacaatcctaagaccttcatcatccacgcggcatggctgcgtcaggctttcgcccattgcgcaagattccccactgctgcctcccgtaggagtctgggccgtgtctcagtcccagtgtggctggccatcctctcagaccagctactgatcgtagccttggtgagccattacctcaccaacaagctaatcagacgcgggccgctccaaaggcgataaatctttcccccgaagggcttatccggtattagcacaagtttccctgtgttgttccgaacctaagggtacgttcccacgtgttactcacccgtccgccactatcccgaaggaccgttcgact

SEQ ID NO: 74 - DNA, 1398 bp, Unknown
  Kingdom: Bacteria, Phylum: Proteobacteria, Class: Gammaproteobacteria, Order: Pseudomonadales, Family: Pseudomonadaceae, Genus: Pseudomonas
tgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcgagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactggtactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttagggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggagg

SEQ ID NO: 75 - DNA, 1409 bp, Unknown
  Kingdom: Bacteria, Phylum: Proteobacteria, Class: Gammaproteobacteria, Order: Xanthomonadales, Family: Xanthomonadaceae, Genus: Stenotrophomonas
cgccctcccgaaggttaagctacctgcttctggtgcaacaaactcccatggtgtgacgggcggtgtgtacaaggcccgggaacgtattcaccgcagcaatgctgatctgcgattactagcgattccgacttcatggagtcgagttgcagactccaatccggactgagatagggtttctgggattggcttaccgtcgccggcttgcagccctctgtccctaccattgtagtacgtgtgtagccctggccgtaagggccatgatgacttgacgtcatccccaccttcctccggtttgtcaccggcggtctccttagagttcccaccattacgtgctggcaactaaggacaagggttgcgctcgttgcgggacttaacccaacatctcacgacacgagctgacgacagccatgcagcacctgtgttcgagttcccgaaggcaccaatccatctctggaaagttctcgacatgtcaaggccaggtaaggttcttcgcgttgcatcgaattaaaccacatactccaccgcttgtgcgggcccccgtcaattcctttgagtttcagtcttgcgaccgtactccccaggcggcgaacttaacgcgttagcttcgatactgcgtgccaaattgcacccaacatccagttcgcatcgtttagggcgtggactaccagggtatctaatcctgtttgctccccacgctttcgtgcctcagtgtcagtgttggtccaggtagctgcgttcgccatggatgttcctcgtgatctctacgcatttcactgctacaccaggaattccgctaccctctaccacactctagtcgtccagtatccactgcagttcccaggttgagcccagggctttcacaacggacttaaacgaccacctacgcacgctttacgcccagtaattccgagtaacgcttgcacccttcgtattaccgcggctgctggcacgaagttagccggtgcttattctttgggtaccgtcatcccaaccgggtattaaccagctggatttctttcccaacaaaagggctttacaacccgaaggccttcttcacccacgcggtatggctggatcaggcttgcgcccattgtccaatattccccactgccgcctcccgtaggagtctggaccgtgtctcagttccagtgtggctgatcatcctctcagaccagctacggatcgtcgccttggtgggcctttaccccgccaactagctaatccgacatcggctcattcaatcgcgcaaggtccgaagatcccctgctttcacccgtaggtcgtatgcggtattagcgtaagtttccctacgttatcccccacgaaaaagtagattccgatgtattcctcacccgtccgccactcgccacccagagagcaagctctcctgtgctgccgttcgacttgca

SEQ ID NO: 76 - DNA, 1396 bp, Unknown
  Kingdom: Bacteria, Phylum: Proteobacteria, Class: Gammaproteobacteria, Order: Pseudomonadales, Family: Pseudomonadaceae, Genus: Pseudomonas
cctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcactcagtgtcagtatcagtccaggtggtcgcgttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgc

SEQ ID NO: 77 - DNA, 1400 bp, Unknown
  Kingdom: Bacteria, Phylum: Proteobacteria, Class: Gammaproteobacteria, Order: Pseudomonadales, Family: Pseudomonadaceae, Genus: Pseudomonas
cgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcagtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgc

SEQ ID NO: 78 - DNA, 1377 bp, Unknown
  Kingdom: Bacteria, Phylum: Bacteroidetes, Class: Cytophagia, Order: Cytophagales, Family: Cytophagaceae, Genus: Hymenobacter
ttcgttgcggagcaccggcttcaggtctaccaaactttcatggcttgacgggcggtgtgtacaaggcccgggaacgtattcaccgcgtcattgctgatacgcgattactagtgattccagcttcacggagtcgagttgcagactccgatccgaactgagaacggcttttcgggattggcgcaccatcgctggttggcaacccgctgtaccgtccattgtagcacgtgtgtagccctaggcgtaagggccatgatgacctgacgtcgtccccgccttcctcactgcttgcgcaggcagtccatctagagtccccgccttgacgcgctggcaactaaatgtaggggttgcgctcgttgcgggacttaacccaacacctcacggcacgagctgacgacggccatgcagcaccttgctttgtgtcccgaaggaaagcgccatctctggcgcggtcacgcgcattctagcctaggtaaggttcctcgcgtatcatcgaattaaaccacatgctccaccacttgtgcgggcccccgtcaattcctttgagtttcacccttgcgggcgtactccccaggtgggatacttaacgctttcgctaagccaccgacattgtatcgccggcagcgagtatccatcgtttacggcgtggactaccagggtatctaatcctgttcgctccccacgctttcgtgcctcagcgtcagttacagcctagtcagctgccttcgcaatcggggttctggatgctatctatgcatttcaccgctacagcatccattccgccaacctcgtctgtactcaagccaaccagtttccagggcagttccgttgttgagcaacgggctttcaccccagacttaatcggccgcctacgcaccctttaaacccaataaatccggacaacgcttgcaccctccgtattaccgcggctgctggcacggagttagccggtgcttattcaccaggtaccgtcagtagcggacgcatccgcttttttcttccctggcaaaagcagtttacgactcagaaagccttcatcctgcacgcggcatggctgggtcaggctctcgcccattgcccaatattccctactgctgcctcccgtaggagtcgggcccgtatctcagtgcccgtgtgggggaccagcctctcagctcccctaagcatcgtcgccttggtgggccgttaccccgccaaccagctaatgctacgcaaccccatccttgaccaataaatctttaataaagagacgatgccgccaccttattttatgcggtattaatccgcctttcggcgggctatcccccagtcaagggcaggttggttacgcgttacgcacccgtgcgccactatcgtattgctacgaccgttcgacttgca

SEQ ID NO: 79 - DNA, 1395 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccactgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagtaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagtcacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgac

SEQ ID NO: 80 - DNA, 1384 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggctcggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcggcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttggctgcgccactaaaatctcaaggattccaacggctagttgacatcgtttacggtgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtc

SEQ ID NO: 81 - DNA, 1400 bp, Unknown
  Kingdom: Bacteria, Phylum: Proteobacteria, Class: Gammaproteobacteria, Order: Pseudomonadales, Family: Pseudomonadaceae, Genus: Pseudomonas
  misc_feature (445)..(445): n is a, c, g, or t
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagcaccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccgacatctcacgacacgagctgacgacagccatgcagcacctgtgtcagagttcccgaaggcaccaatccntctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtgtctaatcctgtttgctccccacgctttcgcacctcagtgtcagtatcagtccaggcggtcgctttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagtaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 82 - DNA, 1381 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctacgcatttcaccgctacacaggaaattccaccaccctctaccgtactctagctcgccagttttggatgcagttcccaggttgagcccggggctttcacatccgacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctccc

SEQ ID NO: 83 - DNA, 1402 bp, Unknown
  Kingdom: Bacteria, Phylum: Proteobacteria, Class: Gammaproteobacteria, Order: Pseudomonadales, Family: Pseudomonadaceae, Genus: Pseudomonas
ccgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgtcagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 84 - DNA, 1393 bp, Unknown
  Kingdom: Bacteria, Phylum: Proteobacteria, Class: Betaproteobacteria, Order: Burkholderiales, Family: Comamonadaceae, Genus: Pelomonas
ggtatcgccctccttgcggttaggctaactacttctggcagaacccgctcccatggtgtgacgggcggtgtgtacaagacccgggaacgtattcaccgcggcaagctgatctgcgattactagcgattccgacttcacgcagtcgagttgcagactacgatccggactacgaccgggtttctgggattagctccccctcgcgggttggcagccctctgtcccggccattgtatgacgtgtgtagccctacccataagggccatgatgacctgacgtcatccccaccttcctccggtttgtcaccggcagtctcattagagtgccctttcgtagcaactaatgacaagggttgcgctcgttgcgggacttaacccaacatctcacgacacgagctgacgacggccatgcagcacctgtgtccaggctctctttcgagcactcccaaatctcttcaggattcctggcatgtcaagggtaggtaaggtttttcgcgttgcatcgaattaaaccacatcatccaccgcttgtgcgggtccccgtcaattcctttgagtttcaaccttgcggccgtactccccaggcggtcaacttcacgcgttagctacgttactgagaagaaaccctcccaacaaccagttgacatcgtttagggcgtggactaccagggtatctaatcctgtttgctccccacgctttcgtgcatgagcgtcagtacaggtccaggggattgccttcgccatcggtgttcctccgcatatctacgcatttcactgctacacgcggaattccatccccctctaccgtactctagccatgcagtcacaaaggcagttcccaggttgagcccggggatttcacctctgtcttgcataaccgcctgcgcacgctttacgcccagtaattccgattaacgcttgcaccctacgtattaccgcggctgctggcacgtagttagccggtgcttattcttcaggtaccgtcatgagtcccaggtattaaccagaaccttttcttccctgacaaaagcggtttacaacccgaaggccttcttcccgcacgcggcatggctggatcaggcttgcgcccattgtccaaaattccccactgctgcctcccgtaggagtctgggccgtgtctcagtcccagtgtggctggtcgtcctctcagaccagctacagatcgttggcttggtgggcctttaccccaccgactacctaatctgatatcggccgctccaatcgcgcgaggtcttgcgatcccccgctttcaccctcaggtcgtatgcggtattagctgctcttccgagcagttatcccccacgactgggcacgttccgatatattactcacccgttcgccactcgtcagcttaacctgttaccgttcgacttgca

SEQ ID NO: 85 - DNA, 1353 bp, Unknown
  Kingdom: Bacteria, Phylum: Proteobacteria, Class: Alphaproteobacteria, Order: Sphingomonadales, Family: Sphingomonadaceae, Genus: Sphingomonas
gcctgcctctcttgcgagttagcgcaacgccttcgggtgaacccaactcccatggtgtgacgggcggtgtgtacaaggcctgggaacgtattcaccgcggcatgctgatccgcgattactagcgattccgccttcatgctctcgagttgcagagaacaatccgaactgagacaacttttggagattagctcaccctcgcgggattgctgcccactgtagttgccattgtagcacgtgtgtagcccagcgcgtaagggccatgaggacttgacgtcatccccaccttcctccggcttatcaccggcggttcctttagagtacccaactaaatgatggtaactaaaggcgagggttgcgctcgttgcgggacttaacccaacatctcacgacacgagctgacgacagccatgcagcacctgtgttccagtccccgaagggaagaaatccatctctggaaatcgtccggacatgtcaaacgctggtaaggttctgcgcgttgcttcgaattaaaccacatgctccaccgcttgtgcaggcccccgccaattcctttgagttttaatcttgcgaccgtactccccaggcggataacttaatgcgttagctgcgccacccaagcaccaagtgcccggacagctagttatcatcgtttacggcgtggactaccagggtatctaatcctgtttgctccccacgctttcgcacctcagcgtcaataccagtccagtgagccgccttcgccactggtgttcttccgaatatctacgaatttcacctctacactcggaattccactcacctctcctggattcaagcgatgcagtcttaaaggcaattccggagttgagccccgggctttcacctctaacttacagagccgcctacgtgcgctttacgcccagtaattccgaataacgctagctcccctcgtattaccgcggctgctggcacgaagttagccggagcttattctcccggtactgtcattatcatcccgggtaaaagagctttacaaccctaaggccttcatcactcacgcggcattgctggatcaggctttcgcccattgtccaatattccccactgctgcctcccgtaggagtctgggccgtgtctcagtcccagtgtggctgatcatcctctcagaccagctaaggatcgtcgccttggtgagcttttacctcaccaactagctaatcctacgcgggctcatccttgggcgataaatctttggtcttacgacatcatccggtattagcagtcatttctaactgttattccgaacccaagggcagattcccacgcgttacgcacccgtgcgccactaaggccgaagccttcgttcgacttgca

SEQ ID NO: 86 - DNA, 1401 bp, Unknown
  Kingdom: Bacteria, Phylum: Proteobacteria, Class: Gammaproteobacteria, Order: Pseudomonadales, Family: Pseudomonadaceae, Genus: Pseudomonas
cgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcctcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgccccccactaccaggcagattcctaggcattactcacccgtccgccgctgaatcaaggagcaagctcccgtcatccgctcgacttgca

SEQ ID NO: 87 - DNA, 1396 bp, Unknown
  Kingdom: Bacteria, Phylum: Proteobacteria, Class: Gammaproteobacteria, Order: Pseudomonadales, Family: Pseudomonadaceae, Genus: Pseudomonas
tcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgctagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagtaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 88 - DNA, 1409 bp, Unknown
  Kingdom: Bacteria, Phylum: Proteobacteria, Class: Gammaproteobacteria, Order: Pseudomonadales, Family: Pseudomonadaceae, Genus: Pseudomonas
tgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttactgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtgacgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaattctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggttaccac

SEQ ID NO: 89 - DNA, 1397 bp, Unknown
  Kingdom: Bacteria, Phylum: Proteobacteria, Class: Gammaproteobacteria, Order: Pseudomonadales, Family: Pseudomonadaceae, Genus: Pseudomonas
ctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgcgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctgcgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagtaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 90 - DNA, 1396 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggctgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagtaaggtattagcttactgcccttcctcccaacttaaagtgctttacaatccgaagaccttcttcacacacgcggcatggctggatcaggctttcgcccattgtccaatattccccactgctgcctctcgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgact

SEQ ID NO: 91 - DNA, 1395 bp, Unknown
  Kingdom: Bacteria, Phylum: Proteobacteria, Class: Gammaproteobacteria, Order: Pseudomonadales, Family: Pseudomonadaceae, Genus: Pseudomonas
tcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccgctggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagtaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgccccccactaccaggcagattcctaggcattactcacccgtccgccgctgaatcaaggagcaagctcccgtcatccgctcgacttgc

SEQ ID NO: 92 - DNA, 1401 bp, Unknown
  Kingdom: Bacteria, Phylum: Proteobacteria, Class: Gammaproteobacteria, Order: Pseudomonadales, Family: Pseudomonadaceae, Genus: Pseudomonas
  misc_feature (30)..(32): n is a, c, g, or t
gtcctcccgaaggttagactagctacttcnnngtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 93 - DNA, 1400 bp, Unknown
  Kingdom: Bacteria, Phylum: Proteobacteria, Class: Gammaproteobacteria, Order: Pseudomonadales, Family: Pseudomonadaceae, Genus: Pseudomonas
cgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcattcaccgctacacaggaaattccaccaccctctaccgtactccagctcgccagttttggatgcagttcccaggttgagcccggggctttcacatccaacttaacgaaccacctacgcgcgctttacgcccagtaattccgattaacgcttgcaccctctgtattaccgcggctgctggcacagagctagccggtgcttattctgtcagtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 94 - DNA, 1399 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtgctccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcagtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 95 - DNA, 1400 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcggtccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 96 - DNA, 1353 bp, Unknown
  Kingdom: Bacteria, Phylum: Proteobacteria, Class: Alphaproteobacteria, Order: Sphingomonadales, Family: Sphingomonadaceae, Genus: Sphingomonas
gcctgcctctcttgcgagttagcgcaacgccttcgggtgaacccaactcccatggtgtgacgggcggtgtgtacaaggcctgggaacgtattcaccgcggcatgctgatccgcgattactagcgattccgccttcatgctctcgagttgcagagaacaatccgaactgagacaacttttggagattagctcaccctcgcgggattgctgcccactgtagttgccattgtagcacgtgtgtagcccagcgcgtaagggccatgaggacttgacgtcatccccaccttcctccggcttatcaccggcggttcctttagagtacccaactaaatgatggtaactaaaggcgagggttgcgctcgttgcgggacttaacccaacatctcacgacacgagctgacgacagccatgcagcacctgtgttccagtccccgaagggaagaaatccatctctggaaatcgtccggacatgtcaaacgctggtaaggttctgcgcgttgcttcgaattaaaccacatgctccaccgcttgtgcaggcccccgtcaattcctttgagttttaatcttgcgaccgtactccccaggcggataacttaatgcgttagctgcgccacccaagcaccaagtgcccggacagctagttatcatcgtttacggcgtggactaccagggtatctaatcctgtttgctccccacgctttcgcacctcagcgtcaataccagtccagtgagccgccttcgccactggtgttcttccgaatatctacgaatttcacctctacactcggaattccactcacctctcctggattcaagcgatgcagtcttaaaggcaattccggagttgagtcccgggctttcacctctaacttacaaagccgcctacgtgcgctttacgcccagtaattccgaataacgctagctcccctcgtattaccgcggctgctggcacgaagttagccggagcttattctcccggtactgtcattatcatcccgggtaaaagagctttacaaccctaaggccttcatcactcacgcggcattgctggatcaggctttcgcccattgtccaatattccccactgctgcctcccgtaggagtctgggccgtgtctcagtcccagtgtggctgatcatcctctcagaccagctaaggatcgtcgccttggtgagcttttacctcaccaactagctaatcctacgcgggctcatccttgggcgataaatctttggtcttacgacatcatccggtattagcagtcatttctaactgttattccgaacccaagggcagattcccacgcgttacgcacccgtgcgccactaaggccgaagccttcgttcgacttgca

SEQ ID NO: 97 - DNA, 1397 bp, Unknown
  Kingdom: Bacteria, Phylum: Proteobacteria, Class: Gammaproteobacteria, Order: Pseudomonadales, Family: Pseudomonadaceae, Genus: Pseudomonas
ctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggcttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattactgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 98 - DNA, 1400 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtactttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 99 - DNA, 1394 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacgcgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctgcacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcagtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctgggccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcga

SEQ ID NO: 100 - DNA, 1399 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggccccctgctttctcccgtaggacgtatgcggtattagcgttcctttcgaaacgttgtcccccactaccaggcagattcctaggcattactcacccgtccgccgctgaatcaaggagcaagctcccgtcgtccgctcgacttgc

SEQ ID NO: 101 - DNA, 1400 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagcaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggccccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 102 - DNA, 1401 bp, Unknown
  Kingdom: Bacteria, Phylum: Proteobacteria, Class: Gammaproteobacteria, Order: Pseudomonadales, Family: Pseudomonadaceae, Genus: Pseudomonas
cgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagctcgccagttttggatgcagttcccaggttgagcccggggctttcgcatccaacttaacgaaccacctacgcgcgctttacgcccagtaattccgattaacgcttgcaccctctgtattaccgcggctgctggcacagagttagccggtgcttattctgtcagtagcgtcaaaacagcaaggtattagcttactgcccttcctcccaacttaaagtgctttacaatccgaagaccttcttcacacacgcggcatggctggatcaggttttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 103 - DNA, 1396 bp, Unknown
  Kingdom: Bacteria, Phylum: Proteobacteria, Class: Gammaproteobacteria, Order: Pseudomonadales, Family: Pseudomonadaceae, Genus: Pseudomonas
ctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttccctaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgcgttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcagtaacgtcaaaacagcaaggtattagcttactgcccttcctcccaacttaaagtgctttacaatccgaagaccttcttcacacacgcggtatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgc

SEQ ID NO: 104 - DNA, 1400 bp, Unknown
  Kingdom: Bacteria, Phylum: Proteobacteria, Class: Gammaproteobacteria, Order: Pseudomonadales, Family: Pseudomonadaceae, Genus: Pseudomonas
gtcctcccgaaggttagactagctacttctggtgcaacccactcccatggtgtgacgggcggtgtgtacaaggcccgggaacgtactcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccataacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgctttcgccactggtgttccttcctatatctacgcatttcaccgctacacaggaaattccaccaccctctaccgtactctagctcgccagttttggatgcagttcccaggttgagcccggggctttcacatccaacttaacgaaccacctacgcgcgctttacgcccagtaattccgattaacgcttgcaccctctgtattaccgcggctgctggcacagagttagccggtgcttattctgtcggtaacgtcaaaacagtaaggtattagcttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatcaaggagcaagctcccgtcatccgctcgacttgca

SEQ ID NO: 105 - DNA, 1548 bp, Unknown
  Kingdom: Bacteria, Phylum: Actinobacteria, Class: Actinobacteria, Order: Actinomycetales, Family: Nocardiaceae, Genus: Rhodococcus
gggtaccgggccccccctcgaggtcgacggtatcgataagcttgatatccactgtggaattcgcccttagagtttgatcctggctcaggacgaacgctggcggcgtgcttaacacatgcaagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctagctacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctgggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgccatgaaagtcggtaacacccgaagccggtggcttaaccccttgtgggagggagccgtcgaaggtgggatcggcgattgggacgaagtcgtaacaaggtaacc

SEQ ID NO: 106 - DNA, 1452 bp, Unknown
  Kingdom: Bacteria, Phylum: Proteobacteria, Class: Gammaproteobacteria, Order: Pseudomonadales, Family: Moraxellaceae, Genus: Enhydrobacter
agagtttgatcctggctcagattgaacgctggcggcaggcttaacacatgcaagtcgaacgatgaaactctagcttgctagagatgattagtggcggacgggtgagtaacatttaggaatctacctagtagtgggggatagctcggggaaactcgaattaataccgcatacgacctacgggtgaaagggggcgcaagctcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcgccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatctttcagagatgagagagtgcctttgggaactcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcggatcagaatgccgcggtgaatacgttcccgggccttgtacacaccgcccgtcacaccatgggagtctattgcaccagaagtaggtagcctaatgcaagagggcgcttaccacggtgtggtcgatgactggggtgaagtcgtaacaaggtaacca

SEQ ID NO: 107 - DNA, 1623 bp, Unknown
  Kingdom: Bacteria, Phylum: Proteobacteria, Class: Gammaproteobacteria, Order: Pseudomonadales, Family: Moraxellaceae, Genus: Enhydrobacter
cggccgctctagaactagtggatcccccgggctgcagcccaatgtggaattcgcccttagagtttgatcctggctcagattgaacgctggcggcaggcttaacacatgcaagtcgaacgatgaaactctagcttgctagagatgattagtggcggacgggtgagtaacatttaggaatctacctagtagtgggggatagctcggggaaactcgaattaataccgcatacgacctacgggtgaaagggggcgcaagctcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatatcgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatctttcagagatgagagagtgcctttgggaactcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcggatcagaatgccgcggtgaatacgttcccgggccttgtacacaccgcccgtcacaccatgggagtctattgcaccagaagtaggtagcctaacgcaagagggcgcttaccacggtgtggtcgatgactggggtgaagtcgtaacaaggtaaccaagggcgaattccacagtggatatcaagcttatcgataccgtcgacctcgagggggggcccggtacccagct

SEQ ID NO: 108 - DNA, 1405 bp, Unknown
  Kingdom: Bacteria, Phylum: Proteobacteria, Class: Gammaproteobacteria, Order: Pseudomonadales, Family: Moraxellaceae, Genus: Perlucidibaca
agagtttgatcctggctcagattgaacgctggcggcaggcctaacacatgcaagtcgagcgggggtagcaataccctagcggcgaacgggtgaggaatgcttgggaatctgcctggtagtgggggataacgttccgaaaggaacgctaataccgcatacgtcctacgggagaaagggggggatcttcggacctctcgctatcagatgagcccaagcgggattagctagttggtgaggtaaaggctcaccaaggcgacgatccctagctggtctgagaggatgatcagccacactggaactgagacacggtccagactcctacgggaggcagcagtggggaatattggacaatgggcgaaagcctgatccagccatgccgcgtgtgtgaagaaggccttcgggttgtaaagcactttaagcggggaggaaggttcgttacttaatacgtaacggaattgacgttacccgcagaataagcaccggctaactctgtgccagcagccgcggtaatacagagggtgcaagcgttaatcggaattactgggcgtaaagcgcgcgtaggcggttgtgtaagttggatgtgaaatccccgggcttaacctgggcactgcattcaaaactgcacggctagagtatgggctgacgctgaggtgcgaaagcatggggagcaaacaggattagataccctggtagtccatgccgtaaacgatgtcgactaggtgttggggaacttgattccttagtgccgcagctaacgcattaagtcgaccgcctggggagtacgaccgcaaggttaaaactcaaatgaattggcgggggcccgcacaagcggtggagcatgtggtttaattcgatgcaacgcgaagaaccttacctactcttgacatccagagaatcctgcagagatgcgggagtgccttcgggaattctgagacaggtgctacatggctgtcgtcagctcgtgtcgtgagatgttgggttaagtcccgcaacgagcgcaacccttatccttagttgccagcacgtaatggtgggaactctagggagactgccggtgacaaaccggaggaaggcggggacgacgtcaagtcatcatggcccttacgagtagggctacacacgtgctacaatggtcggtacagagggtcgcaagcctgcgagggtgagccaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtctgttgcaccagaagtaggtagcttaaccgcaaggagggcgcttaccacggtgtggccgatgactggggtgaagtcgtaacaaggtaaccaagg

SEQ ID NO: 109 - DNA, 1469 bp, Unknown
  Kingdom: Bacteria, Phylum: Proteobacteria, Class: Gammaproteobacteria, Order: Xanthomonadales, Family: Xanthomonadaceae, Genus: Dyella
ccttagagtttgatcctggctcagattgaacgctggcggcatgcctaacacatgcaagtcgaacggcagcacagcagtagcaatactgtgggtggcgagtggcggacgggtgagtaatgcatcgggatctacccaaacgtgggggataacgtagggaaacttacgctaataccgcatacgtcctatgggagaaagcgggggatcgcaagacctcgcgcggttggacgaaccgatgtgcgattagctagttggtagggtaatggcctaccaaggcgacgatcgctagctggtctgagaggatgatcagccacactggaactgagacacggtccagactcctacgggaggcagcagtggggaatattggacaatgggcgcaagcctgatccagcaatgccgcgtgtgtgaagaaggccttcgggttgtaaagcacttttatcaggagcgaaatgccattggttaatacccggtggagctgacggtacctgaggaataagcaccggctaacttcgtgccagcagccgcggtaatacgaagggtgcaagcgttaatcggaattactgggcgtaaagcgtgcgtaggcggtgatttaagtctgctgtgaaatccccgggctcaacctgggaatggcagtggatactggatcgctagagtgtgatagaggatggtggaattcccggtgtagcggtgaaatgcgtatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccttgtccttagttgccagcacgtaatggtgggaactctaaggagactgccggtgacaaaccggaggaaggtggggatgacgtcaagtcatcatggcccttacggccagggctacacacgtactacaatggtcggtacagagggttgcaataccgcgaggtggagccaatcccagaaagccgatcccagtccggatcgaagtctgcaactcgacttcgtgaagtcggaatcgctagtaatcgcagatcagctatgctgcggtgaatacgttcccgggccttgtacacaccgcccgtcacaccatgggagtgagttgctccagaagccgttagtctaaccgcaagggggacgacgaccacggagtggttcatgactggggtgaagtcgtaacaaggtaacc

SEQ ID NO: 110 - DNA, 1448 bp, Unknown
  Kingdom: Bacteria, Phylum: Proteobacteria, Class: Gammaproteobacteria, Order: Enterobacteriales, Family: Enterobacteriaceae, Genus: Escherichia/Shigella
agagtttgatcctggctcagattgaacgctggcggcaggcctaacacatgcaagtcgaatggtaacaggaaacagcttgctgtttcgctgacgagtggcggacgggtgagtaatgtctgggaaactgcctgatggagggggataactactggaaacggtagctaataccgcataacgtcgcaagaccaaagacggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcccgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaagcggccccctggatagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgctgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaatcttcgggagggcgcttaccactttgtgattcatgactggggtgaagtcgtaacaaggtaaccaa

SEQ ID NO: 111 - DNA, 1495 bp, Unknown
  Kingdom: Bacteria, Phylum: Proteobacteria, Class: Betaproteobacteria, Order: Burkholderiales, Family: Comamonadaceae, Genus: Delftia
agagtttgatcctggctcagattgaacgctggcggcatgccttacacatgcaagtcgaacggtaacaggtcttcggacgctgacgagtggcgaacgggtgagtaatacatcggaacgtgcccagtcgtgggggataactactcgaaagagtagctaataccgcatacgatctgaggatgaaagcgggggaccttcgggcctcgcgcgattggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagcaatgccgcgtgcaggatgaaggccttcgggttgtaaactgcttttgtacggaacgaaaaagcttctcctaatacgagaggcccatgacggtaccgtaagaataagcaccggctaactacgtgccagcagccgcggtaatacgtagggtgcaagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggaattagttttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaagtttccagagatggattcgtgctcgaaagagaacctgcacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagcatgccgcggtgaatacgttcccgggtcttgtacacaccgcccgtcacaccatgggagcgggtctcgccagaagtaggtagcctaaccgcaaggagggcgcttaccacggcggggttcgtgactggggtgaagtcgtaacaaggtaacca

SEQ ID NO: 112 - DNA, 464 bp, Unknown
  Kingdom: Bacteria, Phylum: Proteobacteria, Class: Alphaproteobacteria, Order: Rhizobiales, Family: Bradyrhizobiaceae, Genus: Oligotropha
tccatccatgccgcgtgattgatgaccgccctatggttgtatctctcttttgagacgcgacgttctcttcggagcccggaacacaggtgctgcatggctgtcgtcagctcgtgtcgtgagatgttgggttaagtcccgcaacgagcgcaacccccgtccttagttgctaccattcagttgagcactctaaggagactgccggtgataagccgcgaggaaggtggggatgacgtcaagtcctcatggcccttacgggctgggctacacacgtgctacaatggcggtgacaatgggctgcgaggacgcgagtcctagcaaatctccaaaagccgtctcagttcggattgcgctctgcaactcgagcccatgaagttggaatcgctagtaatcgtggatcagcacgccacggtgaatacgttcccgggccttgtacacaccgcccgtcacaccatgggagttggttt

SEQ ID NO: 113 - DNA, 1414 bp, Unknown
  Kingdom: Bacteria, Phylum: Actinobacteria, Class: Actinobacteria, Order: Actinomycetales, Family: Microbacteriaceae, Genus: Microbacterium
agagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtaacca

SEQ ID NO: 114 - DNA, 1535 bp, Unknown
  Kingdom: Bacteria, Phylum: Proteobacteria, Class: Betaproteobacteria, Order: Burkholderiales, Family: Oxalobacteraceae, Genus: Massilia
agagtttgatcctggctcagattgaacgctggcggcatgctttacacatgcaagtcgaacggcagcgcggggtaacctggcggcgagtggcgaacgggtgagtaatatatcggaacgtacccaagagtgggggataacgtagcgaaagttacgctaataccgcatacgatccaaggatgaaagcgggggatcgcaagacctcgtgctcctggagcggccgatatctgattagctagttggtgaggtaaaggctcaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggtagaggctaatatcctttgctaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaagccccgggctcaacctgggaattgcgatggagactgcaatgcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtcaggaagtctggagagatctggatgtgcccgaaagggagcctgaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctagtaatcgcggatcagcatgccgcggtgaatacgttcccgggtcttgtacacaccgcccgtcacaccatgggagcgggttttaccagaagtaggtagcttaaccgtaaggagggcgcttaccacggtaggattcgtgactggggtgaagtcgtaacaaggtaaccaagggcgaattccacagtggatatcaagcttatcgataccgtcga

SEQ ID NO: 115 - DNA, 1435 bp, Unknown
  Kingdom: Bacteria, Phylum: Actinobacteria, Class: Actinobacteria, Order: Actinomycetales, Family: Propionibacteriaceae, Genus: Propionibacterium
agagtttgatcctggctcaggacgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgccgaaagcgtggggagcgaacaggcttagataccctggtagtccacgctgtaaacggtgggtactaggtgtggggtccattccacgggttccgcgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtaaccaagggcgaatt

SEQ ID NO: 116 - DNA, 1332 bp, Unknown
  Kingdom: Bacteria, Phylum: Actinobacteria, Class: Actinobacteria, Order: Actinomycetales, Family: Microbacteriaceae, Genus: Okibacterium
  misc_feature (1302)..(1303): n is a, c, g, or t
  misc_feature (1332)..(1332): n is a, c, g, or t
ttcaccagggttttagcgtgtaaccgctcttgaggggggaccgccccccatgggattgaaaacgggccctaattttttaggggggacacaaggggggattttttcccaatgggggaaagccttaatgaaaaaacccgggggagggaaaggccctttgggtttaaaccttttttccacggaagaaaggaaaaggggcgtccctcagaaaaaggcccgggtaattagtggccagcagccgcggtaataagtgggggccaagagttttccgaaattattgggggaaagaagcttgtagggggtttgttcgcttttggctggaaatccgggaggttcaacctccgggcctgcagtgggtacgggcagattagagtgcggtaggggagatttgaaatccctggtgtagcggtggaatgcgcagattcaggaggaacaccgatggcgaaggcagttctctgggccgtaactgacgctgaggagcgaaaggggcggggagcaaacagggttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggccaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtaaccaagggcgaattccacagtggatatcaagcttatcgataccgtcgacctcgagggggggcccggtacccagctnngtccctttgtaaagacgctagtggcaccn

SEQ ID NO: 117 - DNA, 1431 bp, Unknown
  Kingdom: Bacteria, Phylum: Actinobacteria, Class: Actinobacteria, Order: Actinomycetales, Family: Microbacteriaceae, Genus: Microbacterium
ccttagagtttgatcctggctcaggatgaacgctggcggcgtgcttaacacatgcaagtcgaacggtgaacacggagcttgctctgtgggatcagtggcgaacgggtgagtaacacgtgagcaacctacccctgactctgggataagcgctggaaacggcgtctaatactggatacgagtggcgaccgcatggtcagctactggaaagatttattggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcgcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcacgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtaaccaa

SEQ ID NO: 118 - DNA, 1530 bp, Unknown
  Kingdom: Bacteria, Phylum: Actinobacteria, Class: Actinobacteria, Order: Actinomycetales, Family: Microbacteriaceae, Genus: Microbacterium
agagtttgatcctggctcaggatgaacgctggcggcgtgcttaacacatgcaagtcgaacggtgaacacggagcttgctctgtgggatcagtggcgaacgggtgagtaacacgtgagcaacctacccctgactctgggataagcgctggaaacggcgtctaatactggatacgagtggcgaccgcatggtcagctactggaaagatttattggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaagcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcgactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtaaccaagggcgaattccacagtggatatcaagcttatcgataccgtcg

SEQ ID NO: 119 - DNA, 1451 bp, Unknown
  Kingdom: Bacteria, Phylum: Actinobacteria, Class: Actinobacteria, Order: Actinomycetales, Family: Microbacteriaceae, Genus: Microbacterium
agagtttgatcctggctcaggatgaacgctggcggcgtgcttaacacatgcaagtcgaacggtgaacacggagcttgctctgtgggatcagtggcgaacgggtgagtaacacgtgagcaacctacccctgactctgggataagcgctggaaacggcgtctaatactggatacgagtggcgaccgcatggtcagctactggaaagatttattggttggggatgggctcgcggcctatcagcttgttggtgaggtaatggctcaccaaggcgtcgacgggtagccggcctgagagggtgaccggccacactgggactgagacacggcccagactcctacgggaggcagcagcggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatctagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtaaccaagggcgaattccacagtggatatcaagcttatcgataccgtcga

SEQ ID NO: 120 - DNA, 1365 bp, Unknown
  Kingdom: Bacteria, Phylum: Bacteroidetes, Class: Flavobacteriia, Order: Flavobacteriales, Family: Flavobacteriaceae, Genus: Chryseobacterium
agagtttgatcctggctcaggatgaacgctagcgggaggcctaacacatgcaagccgagcggtatttattcttcggaatagagagagcggcgtacgggtgcggaacacgtgtgcaacctgcctttatcagggggatagcctttcgaaaggaagattaataccccataatatattgaatggcatcatttgatattgaaaactccggtggatagagatgggcacgcgcaagattagatagttggtagggtaacggcctaccaagtcagtgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctttccacgtgtggaaagctgaaggtactatacgaataagcaccggctaactccgtgccagcagccgcggtaatacggagggtgcaagcgttatccggatttattgggtttaaagggtccgtaggcggatctgtaagtcagtggtgaaatctcatagcttaactatgaaactgccatcgatactgcaggtcttgagtaaagtagaagtggctggaataagtagtgtagcggtgaaatgcatagatattactttttttgggtcttcggattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgacaggtttagaaatagacttttcttcggacaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccggtacagagggcagctacctagcgataggatgcgaatctcgaaagccggtctcagttcggattggagtctgcaactcgactctatgaagctggaatcgctagtaatcgcatatcagccatgatgcggtgaatacgttcccgggccttgtacacaccgcccgtcaagccatggaagtttggggtacctgaagtcggtgaccgtaacaggagctgcctagggtaaaacaagtaactagggctaagtcgtaacaaggtaaccaagg

SEQ ID NO: 121 - DNA, 1505 bp, Unknown
  Kingdom: Bacteria, Phylum: Proteobacteria, Class: Betaproteobacteria, Order: Burkholderiales, Family: Oxalobacteraceae, Genus: Herbaspirillum
agagtttgatcctggctcagattgaacgctggcggcatgccttacacatgcaagtcgaacggcagcataggagcttgctcctgatggcgagtggcgaacgggtgagtaatatatcggaacgtgccctagagtgggggataactagtcgaaagactagctaataccgcatacgatctacggatgaaagtgggggatcgcaagacctcatgctcctggagcggccgatatctgattagctagttggtggggtaaaagcctaccaaggcaacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtagtagcgaataactattactaatgacggtacctgaagaataagcaccggctaactacgtgccagcagccgcggtaatacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcccgaagagatttgggagtgctcgaaagagaaccatcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttgtaccagaagtgggtagcctaaccgcaaggagggcgctcaccacggtaggattcgtgactggggtgaagtcgtaacaaggtaaccaagggcgaatt

SEQ ID NO: 122 - DNA, 1331 bp, Unknown
  Kingdom: Bacteria, Phylum: Bacteroidetes, Class: Flavobacteriia, Order: Flavobacteriales, Family: Flavobacteriaceae, Genus: Chryseobacterium
gtttgatcctggctcaggatgaacgctagcgggaggcctaacacatgcaagccgagcggtaggtttccttcgggagactgagagcggcgcacgggtgcggaacacgtgtgcaacctgcctttatcagggggatagcctttcgaaaggaagattaataccccataatattttgagtggcatcacttaaaattgaaaactccggtggataaagatgggcacgcgcaagattagatagttggtgaggtaacggctcaccaagtctacgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctttccacgtgtggaaagctgaaggtactatacgaataagcaccggctaactccgtgccagcagccgcggtaatacggagggtgcaagcgttatccggatttattgggtttaaagggtccgtaggcggatctgtaagtcagtggtgaaatctcacaacttaactgtgaaactgccattgatactgcaggtcttgagtgttgttgaagtagctggaataagtagtgtagcggtgaaatgcatagatattacttcgttttttgggttttcggattcagagactaagcgaaagtgataagttagccacctggggagtacggacgcaagtctgaaactcaaaggaattgacgggggcccgcacaagcggtggattatgtggtttaattcgatgatacgcgaggaaccttaccaaggcttaaatgggaaatgacaggtttagaaatagacttttcttcggacatttttcaaggtgctgcatggttgtcgtcagctcgtgccgtgaggtgttaggttaagtcctacaacgagcgcaacccctgtcactagttgccatcattcagttggggactctagtgagactgcctacgcaagtagagaggaaggtggggatgacgtcaaatcatcacggcccttacgccttgggccacacacgtaatacaatggccagtacagagggcagctaccaggcgactggatgcgaatctcgaaagctggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacagg

SEQ ID NO: 123 - DNA, 1308 bp, Unknown
  Kingdom: Bacteria, Phylum: Proteobacteria, Class: Alphaproteobacteria, Order: Rhizobiales, Family: Rhizobiaceae, Genus: Rhizobium
gccccgcaggggagcggcagacgggtgagtaacgcgtgggaacgtaccctttactacggaataacgcagggaaacttgtgctaataccgtatgtgcccttcgggggaaagatttatcggtaagggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacctgcagagatgcagggttcccttcggggaccgggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggcgttgtacacaccgcccgtcacaccatgggagttggttttacccgaaggt

SEQ ID NO: 124 - DNA, 1455 bp, Unknown
  Kingdom: Bacteria, Phylum: Proteobacteria, Class: Alphaproteobacteria, Order: Rhizobiales, Family: Phyllobacteriaceae, Genus: Mesorhizobium
ttcgcccttagagtttgatcctggctcagaacgaacgctggcggcaggcttaacacatgcaagtcgagcgccccgcaaggggagcggcagacgggtgagtaacgcgtgggaatctacccatcactacggaacaactccgggaaactggagctaataccgtatacgtccttcgggagaaagatttatcggtgatggatgagcccgcgttggattagctagttggtggggtaatggcctaccaaggcgacgatccatagctggtctgagaggatgatcagccacactgggactgaggcacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggatttactgggcgtaaagcgcacgtaggcggattgttaagttaggggtgaaatcccagggctcaaccctggaactgcctttaatactggcaatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgctgtaaacgatggaagctagccgtcggcaagtttacttgtcggtggcgcagctaacgcattaagcttcccgcctggggagtacagtcgcaagattaaaactcaaaggaattgacgggggcccgcacaagcggtggagcatgtggtttaattcgaagcaacgcgcagaaccttaccagcccttgacatcccggtcgcggcctagagagatttaggccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgtccccgggccttgtacacaccgcccgccacaccatgggagttggttttacccgaaggcgctgtgctaaccgcaaggaggcaggcgaccacggtagggtcagcgactggggtgaagtcgtaacaaggtaacc

SEQ ID NO: 125 - DNA, 1523 bp, Unknown
  Kingdom: Bacteria, Phylum: Proteobacteria, Class: Alphaproteobacteria, Order: Rhizobiales, Family: Bradyrhizobiaceae, Genus: Rhodopseudomonas
agagtttgatcctggctcagagcgaacgctggcggcaggcttaacacatgcaagtcgaacgggcgtagcaatacgtcagtggcagacgggtgagtaacacgtgggaacgtaccttttggttcggaacaactgagggaaacttcagctaataccggataagcccttacggggaaagatttatcgccgaaagatcggcccacgtctgattagctagttggtgaggtaatggctcaccaaggcgacgatcagtagctggtctgagaggatgatcagccacattgggactgagacacggcccaaactcctacgggaggcagcagtggggaatattggacaatgggggaaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaagcctggagctcaactccagaactgcctttgatactgaggatcttgagtatgggagaggtgagtggaactgcgagtgtagaggtgaaattcgtagatattcgcaagaacaccagtggcgaaggcggctcactggcccataactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggctttacctgaagacggtgcgctaaccagcaatggaggcagccggccacggtagggtcagcgactggggtgaagtcgtaacaaggtaaccaagggcgaattccacagtggatatcaagcttatcgataccgtcgacctcgagggggggcccggtacccagctt

SEQ ID NO: 126 - DNA, 1565 bp, Unknown
  Kingdom: Bacteria, Phylum: Proteobacteria, Class: Betaproteobacteria, Order: Burkholderiales, Family: Burkholderiaceae, Genus: Burkholderia
aagctgggtaccgggccccccctcgaggtcgacggtatcgataagcttgatatccactgtggaattcgcccttagagtttgatcctggctcagattgaacgctggcggcatgccttacacatgcaagtcggacggcagcgcgggggcaaccctggcggcgagtggcgaacgggtgagtaatacatcggaacgtgtcctggagtgggggatagcccggcgaaagccggattaataccgcatacgctctgtggaggaaagcgggggatcttcggacctcgcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacgtcttggctaatatctggggcggatgacggtaccggaagaataagcaccggctaactacgtgccagcagccgcggtaatacgtagggtgcgagcgttaatcggaattactgggcgtaaagcgtgcgcaggcggttcgctaagaccgatgtgaaatccccgggcttaacctgggaactgcattggcgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaatcctgctgagaggtgggagtgcccgaaagggagctgtaacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcataactggggtgaagtcgtaacaaggtaacc

SEQ ID NO: 127 - DNA, 1506 bp, Unknown
  Kingdom: Bacteria, Phylum: Proteobacteria, Class: Betaproteobacteria, Order: Burkholderiales, Family: Oxalobacteraceae, Genus: Herbaspirillum
agagtttgatcctggctcagattgaacgctggcggcatgccttacacatgcaagtcgaacggcagcataggagcttgctcctgatggcgagcggcgaacgggtgagtaatatatcggaacgtgccctagagtgggggataactagtcgaaagactagctaataccgcatacgatctacggatgaaagtgggggatcgcaagacctcatgctcctggagcggccgatatctgattagctagttggtggggtaaaagcctaccaaggcaacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtagtagcgaataactattactaatgacggtacctgaagaataagcaccggctaactacgtgccagcagccgcggtaatacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaagcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcccgaagagatttgggagtgctcgaaagagaaccatcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgctcaccacggtaggattcgtgactggggtgaagtcgtaacaaggtaaccaagggcgaattc

SEQ ID NO: 128 - DNA, 1483 bp, Unknown
  Kingdom: Archaea, Phylum: Crenarchaeota, Class: Thermoprotei, Order: Sulfolobales, Family: Sulfolobaceae, Genus: Sulfurisphaera
  misc_feature (17)..(17): n is a, c, g, or t
  misc_feature (1463)..(1463): n is a, c, g, or t
  misc_feature (1482)..(1483): n is a, c, g, or t
gcgaactatatgtaccncttattttttatttacaaccttttaaatgtttgtggccagagaaaataagcagatattatcaaaaatattttttataaataaagtgtggggcgatgaaattcttcttggagaactccctggggtgacctccctgtatgagatatatatagtaaggggttattcaaatataagggatctttgctggcgcttatagaaaattccccgcataataaaatttggggataagcatttcccgggggaggctcaacactcctaaagggatacccccccaaggggaaaacaccacctcggatttttttgggggcccaattcgaataattcccagggagaaaatttaacattaaccaaacctggagaaaaaaagcccttggtaaaaaagcctttttgggggaaagaacttagcaatttagtaaacttgtttgatgggaagtgcaaaaaaaaaaacccccattaatttcagccagcagcgggataaaaagggagggaccaaatctataagtaattatgtgaaagaactcgaagggggggatttggttaagtaagataaataaaaggcgcgggatccactgcgggggtctcctttaaaggcggcctgccgggagtttcggggggaaaggggttaattgccggagcggggggatgaagcgattagcattaggaacgacacccgggggggaaggttgtctcggcgtttcaagacgctcaggaaggtaaagaaaggcgggcggaaaagaccatagataacatcccttgttcatcgcactcccacaaaaggaatctaggtagggggtgcattcccacgggttcttggcctgtagaataaagactataataagtccacccccggggaggaatggcccgcgacaggtctaaaaacaaaagaataatggagggggggcgcaaaacacggcggaggcatggtgggttttttattatgacaacaacggagaaacatcatcccgggtttcatcatctatcaggaaagcttctgaggaagggagtgcctcccttcggggaacgatacaacacaaggtgacacggcggtgctgcagctcctgtggtgggaaaatgtgggatatactcccagaaacgagcaacccccgttcacttttgtcaccacggtatggtggggcactcgaaggagactgccggtgataaaccggaggaaggtggggaggacgtcaattcttcatgccccttacgcccagggctacacacggcttccaatggtggtaacaagggggagcaacctcgcgaggtcaagcaaactccataaacccgttcctagtccggatgggagtctgcaactggcctccgagaagtgggattcgttggtattgctgaatcacaatgccgcggtgaatacttctccggggcttgtacacaccgcccgtcacctcatgagagttggtagcaccagagcagtgggcctaaccttcggggantctatatatacgcgtaaann

SEQ ID NO: 129 - DNA, 1220 bp, Unknown
  Kingdom: Bacteria, Phylum: Proteobacteria, Class: Gammaproteobacteria, Order: Enterobacteriales, Family: Enterobacteriaceae, Genus: Kosakonia
ggagggggataactactggaaacggtagctaataccgcataacgtctcaagaccaaagagggggaccttcgggcctcttgccatcagatgtgcccagatgggattagctagtaggcggggtaacggcccacctaggcgacgatccctagctggtctgagaggatgaccagccacactggaactgagacacggtccacactcctacgggaggcagcagtggggaatattgcacaatgggcgcaagcctgatgcatccatgccgcgtgtgtgaagaaggccttcgggttgtaaagcactttcagcggggaggaaggcagtccggttaataaccgtgctgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtctcgtagagggaggtagaattccaggtgtagcggtgaaatgcgtagagatctggaggaataccggtggcgaaagcggcctcctggacgaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacctggcagagatgccggggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtgaatca

SEQ ID NO: 130 - DNA, 1554 bp, Unknown
  Kingdom: Bacteria, Phylum: Actinobacteria, Class: Actinobacteria, Order: Actinomycetales, Family: Streptomycetaceae, Genus: Streptomyces
agagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataacactgcggatcgcatggtctgtggttaaaagctccggcggtgaagggtgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggctagctagagtgtggtaggggagatcggaattcctggcgtagcggtgaaatgcgcagatatcaggaggaacaccggtggcgaaggcggatctctgggccattactgacgctgaggagcgaaagcgtggggagcgaacaggattagataccctggtagtccacgccgtaaacggcgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagctgtcgaaggtgggactggcgattgggacgaagtcgtaacaaggtaaccaagggcgaattccacagtggatatcaagcttatcgataccgtcgacctcgagggggggcccggtacccag

SEQ ID NO: 131 - DNA, 1072 bp, Unknown
  Kingdom: Bacteria, Phylum: Fusobacteria, Class: Fusobacteriia, Order: Fusobacteriales, Family: Leptotrichiaceae, Genus: Sebaldella
agagtttgatcctggctcagatagatggtaggccaagaagaggacgcgagatgcgagagagacgaacggatccacgtaagggaacagggcgggcctgcgtgagctgaagaggacattggtagttccaaaaccaccatgctcggctgcgtgctgtccagccttagcctgaagctcaaaatcggccttggagtcgagcatgtgcaggcttatcatgaagttaccgcgctccacattcgggttcgatcgcggcatcgtcaagctcagcgatacgtcatattcttgctgcgacttcatgggcggcaattcgagtgatgcgatgccatatgggttgacgccggagctgcggccagcaatgtcagcgaaccacaacttgaaattgattacgatgcgatacgctgcgctacatacccatactggaggtggacaggcatcgtcaccacctcatggggaagaaaattctggaaaaagagagccgaagcaatggccgctgtgcaaaagaggatcacagcaccagacaccaggagcacgctattgacgaatgcccgctggactggcttcgacgtgacgatgcgggcagtctcttgaagggtatcctgcgcaggtaaagtgtcagtcgcttacatctgtctgtccaattctggagcgacaactcaccatgctaggccaaatatgtccgacggtgcggactgcatggatgttgcgagagaagggttggttggagtagtgtagcattcaagggagaagcaaagcaatggagctgaggccgtgtatggcatgtgaacgtgggcagctggagctcaacagctcccacgtcataccagggtacgtactgcgcctgcaacaagggcactgcattttaggtacatcaccaacagcaacaacagcaacaacaccaatgcacagcaagcaagaataataaagttgaattgagaattaagaaagtatccatccctagcttagctaagagaaagggcagctcatacaattttgcctgcgtaacaaataccaaacgtcaagtcgtaacaaggtaaccaagggcgaattccacagtggatatcaagcttatcgatac

SEQ ID NO: 132 - DNA, 1428 bp, Unknown
  Kingdom: Bacteria, Phylum: Actinobacteria, Class: Actinobacteria, Order: Actinomycetales, Family: Microbacteriaceae, Genus: Curtobacterium
gtttgatcctggctcaggacgaacgctggcggcgtgcttaacacatgcaagtcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgggatcggtgattaggactaagtcgtaacaaggtaacca

SEQ ID NO: 133 - DNA, 349 bp, Unknown
  Kingdom: Bacteria, Phylum: Proteobacteria, Class: Gammaproteobacteria, Order: Pseudomonadales, Family: Moraxellaceae, Genus: Enhydrobacter
caaggcgacgatctgtaactggtctgagaggatgatcaatcacaccggaactgagacacagtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggctt

SEQ ID NO: 134 - DNA, 231 bp, Unknown
  Kingdom: Bacteria, Phylum: Proteobacteria, Class: Alphaproteobacteria, Order: Sphingomonadales, Family: Sphingomonadaceae, Genus: Sphingomonas
ccttcgggtgctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggc

SEQ ID NO: 135 - DNA, 1254 bp, Unknown
  Kingdom: Bacteria, Phylum: Proteobacteria, Class: Alphaproteobacteria, Order: Sphingomonadales, Family: Sphingomonadaceae, Genus: Sphingomonas
ctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgccctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggcct

SEQ ID NO: 136 - DNA, 1317 bp, Unknown
  Kingdom: Bacteria, Phylum: Actinobacteria, Class: Actinobacteria, Order: Actinomycetales, Family: Micromonosporaceae, Genus: Actinoplanes
gcggcgaacgggtgagtaacacgtgagtaacctgccctggactatgggataaccctcggaaacgggggctaataccggatacgactgctggccgcatggttggtggtggaaagtttttcggtctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtgagtgacggtacctgcagaagaagcgccggccaactacgtgccagcagccgcggtaagacgtagggcgcgagcgttgtccggatttattgggcgtaaagagctcgtaggcggcttgtcgcgtcgtccgtgaaaacctgcagctcaactgcaggcttgcggtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactgtcagagatggcaggtccttcgggggcggtcacaggtggtgcatggctgtcgtcagctcgtgtcgtgagatgttgggttaagtcccgcaacgagcgcaaccctcgtcccatgttgccagcaattcggttggggactcatgggagactgccggggtcaactcggaggaaggtggggatgacgtcaagtcatcatgccccttatgtccagggcttcacgcatgctacaatggccggtacaaaccgttgcgagcccgtgagggggagcgaatcggaaaaagccggtctcagttcggatcggggtctgcaactcgaccccgtgaagtcggagtcgctagtaatcgcagatcagcaacgctgcggtgaatacgttcccgggcggggacacaccgcccgtcacgtcacgaaagtcggcaacacccgaagccg

SEQ ID NO: 137 - DNA, 1514 bp, Unknown
  Kingdom: Bacteria, Phylum: Proteobacteria, Class: Alphaproteobacteria, Order: Rhizobiales, Family: Beijerinckiaceae, Genus: Beijerinckia
gggtaccgggccccccctcgaggtcgacggtatcgataagcttgatatccactgtggaattcgcccttagagtttgatcctggctcagaacgagcgctggcggcaggcttaacacatgcaagtcgaacgctcgtcttcggacgggagtggcagacgggtgagtaacacgtgggaacgtacccttcagttcggaataacccagggaaacttgggctaataccggatacggccgagaggcgaaaggtttactgctgaaggatcggcccgcgtccgattagcttgttggtgtggtaatggcgcaccaaggcatcgatcggtagctggtctgagaggatggccagccacattgggactgagacacggcccaaactcctacgggaggcagcagtggggaatattggacaatgggcgcaagcctgatccagccatgccgcgtgagtgatgaaggccttagggttgtaaagctcttttacctgggaagatcatgacggtaccaggagaataagccccggctaacttcgtgccagcagccgcggtaatacgaagggggctagcgttgttcggatttactgggcgtaaagggcgcgtaggcggacctgtaagtcaggggtgaaatcccgaggctcaacctcggaactgcctttgatactgtgggtcttgagtccgggagaggtgagtggaactgcgagtgtagaggtgaaattcgtagatattcgcaagaacaccagtggcgaaggcggctcactggcccggaactgacgctgaggcgcgaaagcgtggggagcaaacaggattagataccctggtagtccacgccttaaacgatggatgctagccgtcgggcagcttgctgctctgtggcgccgttaacacattaagcatcccgcctggggagtacggtcgcaagattaaaactcaaaggaattgacgggggcccgcacaagcggtggagcatgtggtttaattcgaagcaacgcgcagaaccttaccagcctttgacatggcaggctcggacgagagatcgttcattcccttcggggacctgcacacaggtgctgcatggctgtcgtcagctcgtgtcgtgagatgttgggttaagtcccgcaacgagcgcaacccacgtcctcagttgccatcattcagttgggcactctggggagactgccggtgataagccgagaggaaggtgtggatgacgtcaagtcctcatggcccttacgggctgggctacacacgtgctacaatggcggtgacagagggacgctaacccgcgagggtgtgccaatctctaaaatccgtctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggcgtttcgccaaccgcaaggaggcagacgaccacggtagggtcagcgactggggtgaagtcgtaacaaggtaacc

SEQ ID NO: 138 - DNA, 1363 bp, Unknown
  Kingdom: Bacteria, Phylum: Proteobacteria, Class: Gammaproteobacteria, Order: Enterobacteriales, Family: Enterobacteriaceae, Genus: Erwinia
ttgctccttgggtgacgagtggcggacgggtgagtaatgtctggggatctgcccgatggagggggataactactggaaacggtagctaataccgcataacgtcgcaagaccaaagtgggggaccttcgggcctcacaccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaatttagcagagatgcttgagtgccttcgggaactgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttccctgggccttgtacacaccgcccgtcacaccatgggagtgggttgcaaaagaagtaggtagcta

SEQ ID NO: 139 - DNA, 273 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
aggacgtattcaccgtggcgtgctgatccacgattactagcgattccaacttcatgggctcgagttgcagagcccaatccgaactgagacggctttttgagatttgcgaagggtcgccccttagcatcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggtt

SEQ ID NO: 140 - DNA, 261 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
cagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctacggttgt

SEQ ID NO: 141 - DNA, 419 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
aggacgtattcaccgtggcgtgctgatccacgattactagcgattccaacttcatgggctcgagttgcagagcccaatccgaactgagacggctttttgagatttgcaaagggtcgccccttagcatcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggttgcgctcgttgcgggacttaacccaacatctcacgacacgagctgacgacagccatgcagcacctgtctccggtccagccgaactgaagaactccgtctctggagtccgcgaccgggatgtcaagggctggtaaggttctgcgcgtt

SEQ ID NO: 142 - DNA, 257 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
gggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgtctccgccgttcgccggg

SEQ ID NO: 143 - DNA, 566 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
  misc_feature (565)..(565): n is a, c, g, or t
tgaatgccagccgttagtgggtttactcactagtggcgcagctaacgctttaagcattccgcctcgggagtacggtcgcaagattaaaactcaaaggaattgacgggggcccgcacaagcggtggagcatgtggtttaatttgacgcaacgcgcagaacctcaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgaccctttgcaaatctcaaaaagccgtctcagttcggattgggctctgcaactcgagcccatgaagttggaatcgctagtaatcgtggatcagcacgccacggtgaatacgtcnc

SEQ ID NO: 144 - DNA, 429 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
gatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgc

SEQ ID NO: 145 - DNA, 333 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
gcatgtggtttaattagacgcaacgcgcagaacytcaccagcccttgacatcccggtcgsggactccagagamggagttcttcagttcgggtggacsgragacaggtgctgcatggctgtcgtcagctcgtgtcgtgagatgttgggttaagtcccgcaacgagcgcaacccccgtccttagttgctaccatttagttgagcactctaaggagacygccggtgataagccgcgaggaaggtggggatgacgtcaagtcctcatggcccttacgggstgggctacacacgtgctacaatggcggtgacaatgggatgcwaaggggcgaccsttt

SEQ ID NO: 146 - DNA, 240 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
ggttgtaaagctcttttgtgcgggaagataatgaccgtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaacatcttgagttcgggagaggtgagtggaactgcgagtgtag

SEQ ID NO: 147 - DNA, 473 bp, Unknown
  Kingdom: Bacteria, Phylum: Actinobacteria, Class: Actinobacteria, Order: Actinomycetales, Family: Intrasporangiaceae, Genus: Oryzihumus
ggccagtgagcgcgcgtaatacgactcactatagggcgaattggagctcccgcggtgcggccgctctagaactagtggatcccccgggctgcagcccaatgtggaattcgcccttagagtttgatcctggctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtaaccaagggcgaattccacagtggatatcaagcttatcgataccgtcgacctcgagggggggcccggtacccagcttttgttccctttagtgagggttaattgcgcgcttggcgtaatcatggtcata

SEQ ID NO: 148 - DNA, 364 bp, Unknown
  Kingdom: Bacteria, Phylum: Actinobacteria, Class: Actinobacteria, Order: Coriobacteriales, Family: Coriobacteriaceae, Genus: Adlercreutzia
ggccagtgagcgcgcgtaatacgactcactatagggcgaattggagctcccgcggtgcggccgctctagaactagtggatcccccgggctgcagcccaatgtggaattcgcccttggttaccttgttacgacttttacttcctctaaatgaccgagtttgaccaactttccggcttgaggtggtcgttgccaacctcctcgagccagtccgaaggcctcactgagccaggatcaaactctaagggcgaattccacagtggatatcaagcttatcgataccgtcgacctcgagggggggcccggtacccagcttttgttccctttagtgagggttaattgcgcgcttggcgtaatcatggtcata

SEQ ID NO: 149 - DNA, 166 bp, Unknown
  Kingdom: Bacteria, Phylum: Proteobacteria, Class: Betaproteobacteria, Order: Burkholderiales, Family: Comamonadaceae, Genus: Variovorax
gggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggat

SEQ ID NO: 150 - DNA, 107 bp, Unknown
  Kingdom: Bacteria, Phylum: Proteobacteria, Class: Alphaproteobacteria, Order: Rhizobiales, Family: Phyllobacteriaceae, Genus: Mesorhizobium
ctcccatggtgtgacgggcggtgtgtacaagrcccgggaacgtattcaccgcgrcatgctgatccgcgattactagcgattccaacttcatgcactcgagttgcaga

SEQ ID NO: 151 - DNA, 508 bp, Unknown
  Kingdom: Bacteria, Phylum: Firmicutes, Class: Bacilli, Order: Bacillales, Family: Incertae Sedis XII, Genus: Exiguobacterium
agagtttgatcctggctcaggacgaacgctggcggcgtgcctaatacatgcaagtcgagcgcaggaagtcgacggaacctttcggggggaagtcgatggaatgagcggcggacgggtgagtaacacgtaaagaacctgccctcaggtctgggataaccacgagaaatcggggctaataccggatgggtcatcggaccgcatggtccgaggatgaaaggcgcttcggcgtcgcctggggatggctttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggaacaacgccgcgtgaacgatgaaggccttcgggtcgtaaagttctgttgtaagggaagaacaagtgccgcaggcaatggcggcaccttgacggtaccttgcgaga

SEQ ID NO: 152 - DNA, 585 bp, Unknown
  Kingdom: Bacteria, Phylum: Firmicutes, Class: Bacilli, Order: Bacillales, Family: Incertae Sedis XII, Genus: Exiguobacterium
ccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccagcattcagttgggcactctaaggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgtaacacccgaagtcggtgaggtaaccttagggagccagccgccgaaggtgggacagatgattggggtgaagtcgtaacaaggtaaccaagggcgaattccacagtggatatcaagcttatcgataccgtcgacctcgagggggggcccggtacccagctt

SEQ ID NO: 153 - DNA, 313 bp, Unknown
  Kingdom: Bacteria, Phylum: Actinobacteria, Class: Actinobacteria, Order: Actinomycetales, Family: incertae_sedis, Genus: Sinosporangium
acggccagtgagcgcgcgtaatacgactcactatagggcgaattggagctcccgcggtgcggccgctctagaactagtggatcccccgggctgcagcccaatgtggaattcgcccttggttaccttgttacgacttgcatgtgttaagcacgccgccagcgttcgtcctgagccaggatcaaactctaagggcgaattccacagtggatatcaagcttatcgataccgtcgacctcgagggggggcccggtacccagcttttgttccctttagtgagggttaattgcgcgcttggcgtaatcatggtcatagc

SEQ ID NO: 154 - DNA, 498 bp, Unknown
  Kingdom: Bacteria, Phylum: Firmicutes, Class: Bacilli, Order: Bacillales, Family: Staphylococcaceae, Genus: Staphylococcus
agagtttgatcctggctcaggacgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaa

SEQ ID NO: 155 - DNA, 548 bp, Unknown
  Kingdom: Bacteria, Phylum: Firmicutes, Class: Bacilli, Order: Bacillales, Family: Staphylococcaceae, Genus: Staphylococcus
agctgggtaccgggccccccctcgaggtcgacggtatcgataagcttgatatccactgtggaattcgcccttggttaccttgttacgacttcaccccaatcatttgtcccaccttcgacggctagctccaaatggttactccaccggcttcgggtgttacaaactctcgtggtgtgacgggcggtgtgtacaagacccgggaacgtattcaccgtagcatgctgatctacgattactagcgattccagcttcatatagtcgagttgcagactacaatccgaactgagaacaactttatgggatttgcttgacctcgcggtttcgctgccctttgtattgtccattgtagcacgtgtgtagcccaaatcataaggggcatgatgatttgacgtcatccccaccttcctccggtttgtcaccggcagtcaacttagagtgcccaacttaatgatggcaactaagcttaagggttgcgctcgttgcgggacttaacccaacatctcacgacacgagctgacgacaaccatgcaccacctgtcactctgtcc

SEQ ID NO: 156 - DNA, 465 bp, Unknown
  Kingdom: Bacteria, Phylum: Actinobacteria, Class: Actinobacteria, Order: Actinomycetales, Family: incertae_sedis, Genus: Sinosporangium
ggccagtgagcgcgcgtaatacgactcactatagggcgaattggagctcccgcggtgcggccgctctagaactagtggatcccccgggctgcagcccaatgtggaattcgcccttggttaccttgttacgacttcgtcccaatcgccagtcccaccttcgacagctccctcccacaaggggttgggccaccggcttcgggtgttaccgactttcgtgacgtgacgggcggtgtgtacaaggcccgggaacgtattcaccgcagcaatgctgatctgcgattactagcaactccgacttcatggggtcgagttgcggaccccaatccgaactgagccaggatcaaactctaagggcgaattccacagtggatatcaagcttatcgataccgtcgacctcgagggggggcccggtacccagcttttgttccctttagtgagggttaattgcgcgcttggcgtaatca

SEQ ID NO: 157 - DNA, 536 bp, Unknown
  Kingdom: Bacteria, Phylum: Firmicutes, Class: Bacilli, Order: Bacillales, Family: Bacillaceae , Genus: Bacillus
agagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggttttcggatcgtaaagctctgttgttagggaagaacaagtgccgttcaaatagggcggcaccttgacggtacctaaccagaaagccacggctaactacgtgccagcagccgcggtaatac

SEQ ID NO: 158 - DNA, 584 bp, Unknown
  Kingdom: Bacteria, Phylum: Firmicutes, Class: Bacilli, Order: Bacillales, Family: Bacillaceae , Genus: Bacillus
tttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtaaccaagggcgaattccacagtggatatcaag

SEQ ID NO: 159 - DNA, 653 bp, Unknown
  Kingdom: Bacteria, Phylum: Proteobacteria, Class: Betaproteobacteria, Order: Burkholderiales, Family: Comamonadaceae, Genus: Variovorax
agagtttgatcctggctcagattgaacgctggcggcatgccttacacatgcaagtcgaacggcagcacgggagcaatcctggtggcgagtggcgaacgggtgagtaatacatcggaacgtgcccaatcgtgggggataacgcagcgaaagctgtgctaataccgcataagatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggccttttctaataaagagggctaatgacggtaccgtaagaataagcaccggctaactacgtgccagcagccgcggtaatacgtagggtgcaagcgttaatcggaattactgggcgtaaagcgtgcgcaggcggttatgtaagacagttgtgaaatccccgggctcaacctgggaactgcatctgtgactgcatagctagagtacggtagag

SEQ ID NO: 160 - DNA, 624 bp, Unknown
  Kingdom: Bacteria, Phylum: Proteobacteria, Class: Betaproteobacteria, Order: Burkholderiales, Family: Comamonadaceae, Genus: Variovorax
aggaattgacggggacccgcacaagcggtggatgatgtggtttaattcgatgcaacgcgaaaaaccttacccacctttgacatgtacggaatttgccagagatggcttagtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtcagcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtaaccaagggcgaattccacagtggatatcaag

SEQ ID NO: 161 - DNA, 512 bp, Unknown
  Kingdom: Archaea, Phylum: Crenarchaeota, Class: Thermoprotei, Order: Sulfolobales, Family: Sulfolobaceae, Genus: Stygiolobus
acgatgcataggctgttaccgatttgggtagtgggtgtcgacgggtataatgggcgggaagcagcaaaaaacgtcgacacagcgttgcagcgagaatgtatgcgcgacaggcatcgtgggcacagtgacgctggcttggtgttgaactatcgtcggttgcacctgcagatacgctggattagagccgtctagcgcctctttagtcatggtgactagctgggaagggcgagtcagggatcgtgattggaaacagcctcacggccgtgtatacctagcccgatgcccttcgcgcggcggcgagaatagagagagcgcgcgcctggagagtgcgaccgtggcagcgcgatgcgttagctgcgaatcgaggtcgtgtccttgtgacccagtgtgacgggcaagagaacgacggccaggctcccagccgccgcaggcagattgcgacggcatcaagggccagaggcggcaggcaatcatcgctcacagcctccgccggcgaccgtcctgctcgatac

SEQ ID NO: 162 - DNA, 226 bp, Unknown
  Kingdom: Bacteria, Phylum: Proteobacteria, Class: Betaproteobacteria, Order: Burkholderiales, Family: Comamonadaceae, Genus: Variovorax
agatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggat

SEQ ID NO: 163 - DNA, 538 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
agagtttgatcctggctcagagcgaacgctggcggcaggcttaacacatgcaagtcgagcgggcatagcaatatgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtca

SEQ ID NO: 164 - DNA, 583 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
  misc_feature (4)..(4): n is a, c, g, or t
attngacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtaaccaagggcgaattccacagtggatatcaag

SEQ ID NO: 165 - DNA, 217 bp, Unknown
  Kingdom: Bacteria, Phylum: Firmicutes, Class: Bacilli, Order: Lactobacillales, Family: Carnobacteriaceae, Genus: Atopostipes
caggtggtgcatggttgtcgtcagctcgtgtcgtgagatgttgggttaactcccataacgggcgcaacccttattgttagttgccagcattcagttgggcactctagcgagactgccggtgataaaccggaggaaggtggggatgacgtcaaatcatcatgccccttatgagctgggctacacacgtgctacaatggacggtacaacgagtggcgag

SEQ ID NO: 166 - DNA, 374 bp, Unknown
  Kingdom: Bacteria, Phylum: Firmicutes, Class: Bacilli, Order: Lactobacillales, Family: Carnobacteriaceae, Genus: Atopostipes
ttggtgaggtaatggctcaccaaggcaacgatacttagccgacctgagagggtgatcggccacactgggactgagacacggcccatactcctacgggaggcagcagtaaggaatcttccacaatgggtgcaaacctgatggagcaatgccgcgtgaatgaagaaggtcttcggatcgtaaagttctgttattagagaacaacaagttgaggagtaactgcctcagccttgacagtatctaaccagaaagtcacggctaactacgtgccagcagccgcggtaatacgtaggtgacaagcgttgtccggaattattgggcgtaaagggagcgcacgcggttggaatagtctgatgtgaaagcccacggcttaaccg

SEQ ID NO: 167 - DNA, 552 bp, Unknown
  Kingdom: Bacteria, Phylum: Proteobacteria, Class: Gammaproteobacteria, Order: Enterobacteriales, Family: Enterobacteriaceae, Genus: Serratia
ggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtagcattctgatctacgattactagcgattccgacttcatggagtcgagttgcagactccaatccggactacgacgtactttatgaggtccgcttgctctcgcgaggtcgcttctctttgtatacgccattgtagcacgtgtgtagccctactcgtaagggccatgatgacttgacgtcatccccaccttcctccagtttatcactggcagtctcctttgagtccccggccgaaccgctggcaacaaaggataagggttgcgctcgttgcgggacttaacccaacatttcacaacacgagctggcgacagccatgcagcacctgtctcagagttcccgaaggcaccaaagcatctctgctaagttctctggatgtcaagagtaggtaaggttcttcgcgttgcatcgaat

SEQ ID NO: 168 - DNA, 533 bp, Unknown
  Kingdom: Bacteria, Phylum: Proteobacteria, Class: Gammaproteobacteria, Order: Enterobacteriales, Family: Enterobacteriaceae, Genus: Serratia
agttagccggtgcttcttctgcgagtaacgtcaattgatgagcgtattaagctcaccaccttcctcctcgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagccattaccccacctactagctagtcccatctgggcgcatctgatggcaagaggcccgaaggtccccctctttggtcttgcgacgttatgcggtattagctaccgtttccagtagttatccccctccatcaggcagtttcccagacattactcacccgtccgccgctcgtcacccagagagcaagctcccctgtgctaccgctcgacttgcatgtgttaagcctgccgccagcgttcaatctgagccaggatcaaactctaagggcgaattccacagtggatatcaag

SEQ ID NO: 169 - DNA, 566 bp, Unknown
  Kingdom: Archaea, Phylum: Crenarchaeota, Class: Thermoprotei, Order: Sulfolobales, Family: Sulfolobaceae, Genus: Sulfurisphaera
cagcaacaaaaggaccaccaaagccgcccatggcggcagtttgaagaacggagaagagtgaaccgacggtcacgaggccgatcttggcttacctaattgcggcgatacttcctgtataatgtcaactccacgagccaagcaacgatacggactgtctcacctgcaacgggtcctgccgcactgaagcccaggaatcccaggaagttcgatgtaaactgcgcgaaaagaagggggacaaagaccctgccagcagcatttgtgggggagatgtgcttgtaccagggaggcggaggtggagggaacattggagtacatcaagcagatgcacttgatgatgtcggcgatgatgagaagtttaaacgcgattatgaagggtcggctggctttgataatcctcgcgcggaaggcgttgccggccatggtgatgaaagcgaggccgtagtgaaggggcgtgtcatgcgcttcgaggtgctcccggtcggcgtcgctggcgtaggcgtgggcgtgggacatgttttgtggtgtctggctgttgggatatgggctataacggtggtaatcgacga

SEQ ID NO: 170 - DNA, 604 bp, Unknown
  Kingdom: Bacteria, Phylum: Verrucomicrobia, Class: Opitutae, Order: Puniceicoccales, Family: Puniceicoccaceae, Genus: Coraliomargarita
gggctataacggtggtaatcgacgaacaaaataaagtttgcgggccgatctcggcggaggtaaatgacgtcaggaaagcgtggggagtgaatgagagggagagctttggcgcacgtgacgtcgcgatttacctgaaattcgagtgccacagcgcctcaccaaatactactgtatcacacgttggggtagaggcatttgtcaggcttggaaaagtcaggcacgtcgtgattattgcgacacgctcgcgacttcctaatcggaccataccggcagtgtttgagtcaaacaaatcgccgatgatgtcaccaatatatcggaatacactagcgcagaaacgtagtcattttcagcttgaactggctgtacgcgaaatatctcggatttctgtgacctctggaggtgaacccaattatgcttctatattggagatcttgagcaacgacaacatcgaagacaaataaaactttgcgctaattccaataagataaacatgattctttctgcgtgtatcatgagagcaatctgagccaggatcaaactctaagggcgaattccacagtggatatcaagcttatcgataccgtcgacctcgagggggggcccg

SEQ ID NO: 171 - DNA, 668 bp, Unknown
  Kingdom: Bacteria, Phylum: Proteobacteria, Class: Gammaproteobacteria, Order: Enterobacteriales, Family: Enterobacteriaceae, Genus: Enterobacter
ggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcagagttcccgaaggcaccaaagcatctctgctaagttctctggatgtcaagagtaggtaaggttcttcgcgttgcatcgaattaaaccacatgctccaccgcttgtgcgggcccccgtcaattcatttgagttttaaccttgcggccgtactccccaggcggtcgatttaacgcgttagctccggaagccacgcctca

SEQ ID NO: 172 - DNA, 564 bp, Unknown
  Kingdom: Bacteria, Phylum: Proteobacteria, Class: Gammaproteobacteria, Order: Enterobacteriales, Family: Enterobacteriaceae, Genus: Serratia
gtgcttcttctgcgagtaacgtcaattgatgagcgtattaagctcaccaccttcctcctcgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagccattaccccacctactagctaatcccatctgggcacatctgatggcaagaggcccgaaggtccccctctttggtcttgcgacgttatgcggtattagctaccgtttccagtagttatccccctccatcaggcagtttcacagacattactcacccgtccgccgctcgtcacccagagagcaagctcccctgtgctaccactcgacttgcatgtgttaagcctgccgccagcgttcaatctgagccaggatcaaactctaagggcgaattccacagtggatatcaagcttatcgataccgtcgacctcgagggggggcccggtaccc

SEQ ID NO: 173 - DNA, 614 bp, Unknown
  Kingdom: Archaea, Phylum: Euryarchaeota, Class: Halobacteria, Order: Halobacteriales, Family: Halobacteriaceae, Genus: Halobaculum
agagtttgatcctggctcagattgggatcaggcccaacgacagtgcgacccgagaagtcgacacgctttccagataggttctggcggaaacggccgccctttcccttgagacgctggcagaaaccgcgcatcgtcttttgcaggccttgttgcttcaggccgggcgagtcgctgttgatgtacatggcaatctgcaactggagaaagtcccactgctccataggcacctgcagagggaagccgtcgcgcagaccggcacggatgatgccgctgatgtgggtgatgtcgccaatcttgttggtgatgtcgtcttcggtagcaccggcctcctggaccaccgagggccggatgtagacaggcggcactggcacgtactcccatatcagcatctccggccgggcgtcctcgggaatcatgtacagcagctcgcagtcctcgtcagatatcctcttgaagatgttcagcacacgcagcgggtgcatgtcgtcgacggccttcttcacgtgcttctcgacatccggattcccgaccttggccgtctcgaacgactggtcgaactcctgctttccgggcggcagcttcttcaccttggccgtggagcggtcgtaggcgtc

SEQ ID NO: 174 - DNA, 606 bp, Unknown
  Kingdom: Archaea, Phylum: Euryarchaeota, Class: Halobacteria, Order: Halobacteriales, Family: Halobacteriaceae, Genus: Halosimplex
cacacgcagcgggtgcatgtcgtcgacggccttcttcacgtgcttctcgacatccggattcccgaccttggccgtctcgaacgactggtcgaactcctgctttccgggcggcagcttcttcaccttggccgtggagcggtcgtaggcgtcgtagcggcggtggatgatcttcagcggatggccggcgactttgcgcacagtgccgttgaggccgtggcagtaggggcagaacttgcgcttgcggcactcctccatgatgcggcgggcgaggttggtgcgctgcaggttgtccattccggggcggcgcatgctgcgcaggtggcgcttgcgctcgtcgggctcgagcaacacgcgcgagcagtccttgcataccgtgtgcagcacctcgatgatgtgcttgaggtagccgacgtggaagacgggcagcgcgagcttgatgtggccaaagtggccgttgcacgtgtcgaggccctcgccgcacgtcttgcagaggccggtcttcgtcgagatgcccatgaggggatccatggggccgtgcttggtgtgctggcgctcgttgttcggacctggggtgaagtcgtaacaaggtaaccaagggcgaattcc

SEQ ID NO: 175 - DNA, 500 bp, Unknown
  Kingdom: Bacteria, Phylum: Proteobacteria, Class: Gammaproteobacteria, Order: Xanthomonadales, Family: Xanthomonadaceae, Genus: Luteibacter
ggacctacccagacgtgggggataacgtagggaaacttacgctaataccgcatacgtcctacgggagaaagcgggggatcgcaagacctcgcgcggttggatggaccgatgtgcgattagctagttggtaaggtagcggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaagcggttcgttaagtctgttgtgaaagccccgggctcaacctgg

SEQ ID NO: 176 - DNA, 543 bp, Unknown
  Kingdom: Bacteria, Phylum: Proteobacteria, Class: Gammaproteobacteria, Order: Xanthomonadales, Family: Xanthomonadaceae, Genus: Luteibacter
cgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacgga

SEQ ID NO: 177 - DNA, 582 bp, Unknown
  Kingdom: Bacteria, Phylum: Actinobacteria, Class: Actinobacteria, Order: Actinomycetales, Family: Microbacteriaceae, Genus: Pseudoclavibacter
ggttaccttgttacgacttagtcctaatcaccgatcccaccttcgacggctccctccaaaaggttgggccaccggctccgggtgttaccgactttcatgacttgacgggcggtgtgtacaaggcccgggaacgtattcaccgcagcgttgctgatctgcgattactagcgactccgacttcatggggtcgagttgcagaccccaatccgaactgagaccggctttttgggattcgctccaccttgcggtattgctgccctttgtaccggccattgtagcatgcgtgaagcccaagacataaggggcatgatgatttgacgtcatccccaccttcctccgagttgaccccggcagtctcatatgagttcccaccattacgtgctggcaacatacgacgagggttgcgctcgttgcgggacttaacccaacatctcacgacacgagctgacgacaaccatgcacaacctgtataccgaccttgcggggcgactatctctagccgtttccggtatatgtcaagccttggtaaggttcttcgcgttgcatcgaattaatccgcatgctccgccgcttgtgcgggcc

SEQ ID NO: 178 - DNA, 467 bp, Unknown
  Kingdom: Bacteria, Phylum: Actinobacteria, Class: Actinobacteria, Order: Actinomycetales, Family: Microbacteriaceae, Genus: Zimmermannella
aagctgggtaccgggccccccctcgaggtcgacggtatcgataagcttgatatccactgtggaattcgcccttagagtttgatcctggctcaggacgaacgctggcggcgtgcttaacacatgcaagtcaaacgatgaacgaggagcttgctcctccggattagtggcgaacgggtgagtaacacgtgagcaacgtgcccaagactctggaataacttcgggaaaccgaagctaataccggatacgagacgcgaaggcatcttcagcgtctggaaagaacttcggtcttggatcggctcacggcctatcagcttgtcggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcaacgccgc

SEQ ID NO: 179 - DNA, 1345 bp, Unknown
  Kingdom: Bacteria, Phylum: Proteobacteria, Class: Gammaproteobacteria, Order: Enterobacteriales, Family: Enterobacteriaceae, Genus: Serratia
ggcccgggaacgtattcaccgtagcattctgatctacgattactagcgattccgacttcatggagtcgagttgcagactccaatccggactacgacgtactttatgaggtccgcttgctctcgcgaggtcgcttctctttgtatacgccattgtagcacgtgtgtagccctactcgtaagggccatgatgacttgacgtcatccccaccttcctccagtttatcactggcagtctcctttgagttcccggccgaaccgctggcaacaaaggataagggttgcgctcgttgcgggacttaacccaacatttcacaacacgagctgacgacagccatgcagcacctgtctcagagttcccgaaggcaccaatccatctctggaaagttctctggatgtcaagagtaggtaaggttcttcgcgttgcatcgaattaaaccacatgctccaccgcttgtgcgggcccccgtcaattcatttgagttttaaccttgcggccgtactccccaggcggtcgatttaacgcgttagctccggaagccacgcctcaagggcacaacctccaaatcgacatcgtttacagcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactctagcttgccagtttcaaatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgagtaacgtcaattgatgaacgtattaagttcaccaccttcctcctcgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagccattaccccacctactagctaatcccatctgggcacatctgatggcaagaggcccgaaggtccccctctttggtcttgcgacgttatgcggtattagctaccgtttccagtagttatccccctccatcaggcagtttcccagacattactcacccgtccgccgctcgtcacccagggagcaagctcccctgtgctaccgctcgacttgcatgtgttaagcc

SEQ ID NO: 180 - DNA, 595 bp, Unknown
  Kingdom: Bacteria, Phylum: Proteobacteria, Class: Gammaproteobacteria, Order: Enterobacteriales, Family: Enterobacteriaceae, Genus: Serratia
agagtttgatcctggctcagattgaacgctggcggcaggcttaacacatgcaagtcgagcggtagcacaagggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcaga

SEQ ID NO: 181 - DNA, 549 bp, Unknown
  Kingdom: Bacteria, Phylum: Proteobacteria, Class: Gammaproteobacteria, Order: Enterobacteriales, Family: Enterobacteriaceae, Genus: Serratia
tgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccaagggcgaattccacagtggatatcaagcttatcgataccgtcgacctcgagggggggcccgg

SEQ ID NO: 182 - DNA, 564 bp, Unknown
  Kingdom: Bacteria, Phylum: Proteobacteria, Class: Gammaproteobacteria, Order: Enterobacteriales, Family: Enterobacteriaceae, Genus: Serratia
agagtttgatcctggctcagattgaacgctggcggcaggcttaacacatgcaagtcgagcggtagcacaagggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctaagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgt

SEQ ID NO: 183 - DNA, 578 bp, Unknown
  Kingdom: Bacteria, Phylum: Proteobacteria, Class: Gammaproteobacteria, Order: Enterobacteriales, Family: Enterobacteriaceae, Genus: Serratia
tcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccaagggcgaattccacagtggatatcaag

SEQ ID NO: 184 - DNA, 651 bp, Unknown
  Kingdom: Bacteria, Phylum: Proteobacteria, Class: Gammaproteobacteria, Order: Enterobacteriales, Family: Enterobacteriaceae, Genus: Serratia
ggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtagcattctgatctacgattactagcgattccgacttcatggagtcgagttgcagactccaatccggactacgacgtactttatgaggtccgcttgctctcgcgaggtcgcttctctttgtatacgccattgtagcacgtgtgtagccctactcgtaagggccatgatgacttgacgtcatccccaccttcctccagtttatcactggcagtctcctttgagttcccggccgaaccgctggcaacaaaggataagggttgcgctcgttgcgggacttaacccaacatctcacaacacgagctgacgacagccatgcagcacctgtctcagagttcccgaaggcaccaatccatctctggaaagttctctggatgtcaagagtaggtaaggttcttcgcgttgcatcgaattaaaccacatgctccaccgcttgtgcgggcccccgtcaattcatttgagttttaaccttgcggccgtactccccaggcggtcgatttaacgcgttagct

SEQ ID NO: 185 - DNA, 564 bp, Unknown
  Kingdom: Bacteria, Phylum: Proteobacteria, Class: Gammaproteobacteria, Order: Enterobacteriales, Family: Enterobacteriaceae, Genus: Serratia
caccctccgtattaccgcggctgctggcacggagttagccggtgcttcttctgcgagtaacgtcaattgatgagcgtattaagctcaccaccttcctcctcgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggttagccattaccccacctactagctaatcccatctgggcacatctgatggcaagaggcccgaaggtccccctctttggtcttgcgacgttatgcggtattagctaccgtttccagtagttatccccctccatcaggcagtttcccagacattactcacccgtccgccgctcgtcacccagggagcaagctcccttgtgctaccgctcgacttgcatgtgttaagcctgccgccagcgttcaatctgagccaggatcaaactctaagggcgaattccacagtggatatcaa

SEQ ID NO: 186 - DNA, 479 bp, Unknown
  Kingdom: Bacteria, Phylum: Proteobacteria, Class: Gammaproteobacteria, Order: Enterobacteriales, Family: Enterobacteriaceae, Genus: Serratia
gaaactgcctgatggagggggataactactggaaacggtagctaataccgcataacgtcgcaagaccaaagagggggaccttcgggcctcttgccatcagatgtgcccagatgggattagctagtaggtggggtaatggctaacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtg

SEQ ID NO: 187 - DNA, 585 bp, Unknown
  Kingdom: Bacteria, Phylum: Proteobacteria, Class: Gammaproteobacteria, Order: Enterobacteriales, Family: Enterobacteriaceae, Genus: Serratia
gagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccacttt

SEQ ID NO: 188 - DNA, 458 bp, Unknown
  Kingdom: Bacteria, Phylum: Proteobacteria, Class: Gammaproteobacteria, Order: Enterobacteriales, Family: Enterobacteriaceae, Genus: Serratia
ggcccgggaacgtattcaccgtagcattctgatctacgattactagcgattccgacttcatggagtcgagttgcagactccaatccggactacgacgtactttatgaggtccgcttgctctcgcgaggtcgcttctctttgtatacgccattgtagcacgtgtgtagccctactcgtaagggccatgatgacttgacgtcatccccaccttcctccagtttatcactggcagtctcctttgagttcccggccgaaccgctggcaacaaaggataagggttgcgctcgttgcgggacttaacccaacatttcacaacacgagctgacgacagccatgcagcacctgtctcagagttcccgaaggcaccaatccatctctggaaagttctctggatgtcaagagtaggtaaggttcttcgcgttgcatcgaattaaaccacatgctccaccgcttgtgcg

SEQ ID NO: 189 - DNA, 619 bp, Unknown
  Kingdom: Bacteria, Phylum: Proteobacteria, Class: Gammaproteobacteria, Order: Enterobacteriales, Family: Enterobacteriaceae, Genus: Serratia
tacgagactctagcttgccagtttcaaatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgagtaacgtcaattgatgaacgtattaagttcaccaccttcctcctcgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagccattaccccacctactagctaatcccatctgggcacatctgatggcaagaggcccgaaggtccccctctttggtcttgcgacgttatgcggtattagctaccgtttccagtagttatccccctccatcaggcagtttcccagacattactcacccgtccgccgctcgtcacccagggagcaagctcccctgtgctaccgctcgacttgcatgtgttaagcc

SEQ ID NO: 190 - DNA, 404 bp, Unknown
  Kingdom: Bacteria, Phylum: Proteobacteria, Class: Betaproteobacteria, Order: Burkholderiales, Family: Comamonadaceae, Genus: Variovorax
ccgcctggggagtacggccgcaaggttraaactcaaaggaattgacggggacccgcacaagcggtggatgatgtggtttaattcgatgcaacgcgaaaaaccttacccacctttgacatgtacggaatttgccagagatggyttagtgctkgaaagagaaccgtaacacaggtgctgcatggtctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaat

SEQ ID NO: 191 - DNA, 625 bp, Unknown
  Kingdom: Bacteria, Phylum: Proteobacteria, Class: Betaproteobacteria, Order: Burkholderiales, Family: Comamonadaceae, Genus: Variovorax
  misc_feature (529)..(529): n is a, c, g, or t
aaagctgtgctaataccgcataaratctacsgatgaaagcaggggatcgcaagaccttgcgcgaatggagcggccgatggcagattasgtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggccttttctaataaagagggctaatgacrgtaccgtaagaataagcaccggctaactacgtgccagcagccgcggtaatacgtagggtgcaagcgttaatcggaattactgggcgtaaagcgtgcgcaggcggttatgtaagacagttgtgaaatccccgggctcaacctgggaactgcatctgtgactgcatagctagagtacggtagagggggatggaattccrcgtgtancagtgaaatgcgtagatatgcggaggaacaccgatggcgaaggcaatcccctggacctgtactgacgctcatgcacgaaagcgtggggagcaaaca

SEQ ID NO: 192 - DNA, 610 bp, Unknown
  Kingdom: Bacteria, Phylum: Firmicutes, Class: Bacilli, Order: Bacillales, Family: Bacillaceae , Genus: Bacillus
ggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttccc

SEQ ID NO: 193 - DNA, 480 bp, Unknown
  Kingdom: Archaea, Phylum: Nanohaloarchaeota, Class: Nanohaloarchaea, Order: Incertae sedis, Family: Incertae sedis, Genus: Candidatus Haloredivivus
actattccctctactgttagaccaaccgttaagcggctcatgacctagcgttggctctggcctggtgtctcgtagccgacgggtgacttcgccgcacgagcagtagtctgcatgcccaggtggttaggcaacacggctagcggcagatcgcagtgaaagggtgcggtgcacggttgcatctgttacgggaagcgacgacatcgctttctcgaggctctgctgggagtaacaagttcaccgcgaaatgcatttttgctctcacgcaatatattagtagcccgcacctgcctagcacctttaagtgatcgccacttgtccttcccgttccacccatgcattgattagcaatacacaaggcaacacaggacgaccaccctctcagcgcatgagtgcaacagcataatttctccctctcgccgcaacagagattgctgcgaccagaaaaacatcacagcgattagcgatactcgtctccacata

SEQ ID NO: 194 - DNA, 451 bp, Unknown
  Kingdom: Archaea, Phylum: Euryarchaeota, Class: Archaeoglobi, Order: Archaeoglobales, Family: Archaeoglobaceae, Genus: Ferroglobus
tgagcgagagcgagcggagcggtaggttgcgcaaggctaggtcttgaagtatctgtgctaataggcgatagattttgcatatgcgatattgcgctcgctgcgaacatcgtccatcgccggcatcgtcgaaaagctgaacccgctcctacacctcgaccccgtcgtatacctcccgcccgaactgaccttccagatcctctcgtacctagatcccgaaatactattacgcgcatcgacgctgtcacgagcatggagggagagggtgctggacagccccctgtggaagctgctgtttagattagaaggctggaactctaacttcccgcaagtgcgcgcatacgaggacgctcagaggcagaagcgcgcagagttcaaggagaaggagcgtaagacgcgacatcgtgcagccgaagacacggactacggcaagccatcgcacaagaagcgtgta

SEQ ID NO: 195 - DNA, 595 bp, Unknown
  Kingdom: Bacteria, Phylum: Proteobacteria, Class: Gammaproteobacteria, Order: Xanthomonadales, Family: Xanthomonadaceae, Genus: Luteibacter
agtttgatcattcagattgaacgctggcggcatgcttaacacatgcaagtcgaacggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtaaggtaacggcttaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgttgtga

SEQ ID NO: 196 - DNA, 572 bp, Unknown
  Kingdom: Bacteria, Phylum: Proteobacteria, Class: Gammaproteobacteria, Order: Xanthomonadales, Family: Xanthomonadaceae, Genus: Luteibacter
ttcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtggttcatgactggggtgaagtcgtaacaagggcgaattccacagtggatatcaag

SEQ ID NO: 197 - DNA, 630 bp, Unknown
  Kingdom: Archaea, Phylum: Nanohaloarchaeota, Class: Nanohaloarchaea, Order: Incertae sedis, Family: Incertae sedis, Genus: Candidatus Haloredivivus
agtttgatcatggctcagattgcagctgcaaagctcgagaagaataattacctcgaagtaccatgtcgttctcgcactactccagagatgcaagatatcaagcacctgcagagtgccctagactattccctctactgttagaccaaccgttaagcggctcatgacctagcgttggctctggcctggtgtctcgtagccgacgggtgacttcgccgcacgagcagtagtctgcatgcccaggtggttaggcaacacggctagcggcagatcgcagtgaaagggtgcggtgcacggttgcatctgttacgggaagcgacgacatcgctttctcgaggctctgctgggagtaacaagttcaccgcgaaatgcatttttgctctcacgcaatatattagtagcccgcacctgcctagcacctttaagtgatcgccacttgtccttcccgttccacccatgcattgattagcaatacacaaggcaacacaggacgaccaccctctcagcgcatgagtgcaacagcataatttctccctctcgccgcaacagagattgctgcgaccagaaaaacatcacagcgattagcgatactcgtctccacataacttaacccaccgcgcgcgcaccacaatg

SEQ ID NO: 198 - DNA, 630 bp, Unknown
  Kingdom: Archaea, Phylum: Euryarchaeota, Class: Archaeoglobi, Order: Archaeoglobales, Family: Archaeoglobaceae, Genus: Ferroglobus
ggagtcatcgtccagcctacccgattgggtcctggctctgagcgagagcgagcggagcggtaggttgcgcaaggctaggtcttgaagtatctgtgctaataggcgatagattttgcatatgcgatattgcgctcgctgcgaacatcgtccatcgccggcatcgtcgaaaagctgaacccgctcctacacctcgaccccgtcgtatacctcccgcccgaactgaccttccagatcctctcgtacctagatcccgaaatactattacgcgcatcgacgctgtcacgagcatggagggagagggtgctggacagccccctgtggaagctgctgtttagattagaaggctggaactctaacttcccgcaagtgcgcgcatacgaggacgctcagaggcagaagcgcgcagagttcaaggagaaggagcgtaagacgcgacatcgtgcagccgaagacacggactacggcaagccatcgcacaagaagcgtgtacgggagcggcagctgtttggcgagggctcagcatcggagagtggtatacataacacgctagaaccgctgtctattgaaggctctaccgggaatgcctggggtgaagtcgtaacaagggcgaattccacagtggatatcaag

SEQ ID NO: 199 - DNA, 638 bp, Unknown
  Kingdom: Bacteria, Phylum: Actinobacteria, Class: Actinobacteria, Order: Actinomycetales, Family: Propionibacteriaceae, Genus: Propionibacterium
gaacgtattcaccgcagcgttgctgatctgcgattactagcgactccgacttcatgaggtcgagttgcagaccccaatccgaactgagaccggctttccgagattcactcaccctcacaggctcgccactctctgtaccagccattgtagcatgcgtgaagccctggacataaggggcatgatgacttgacgtcatccccaccttcctccgagttgaccccggcggtctccactgagtccccaccataacgtgctggcaacagtgaacaagggttgcgctcgttgcgggacttaacccaacatctcacgacacgagctgacgacagccatgcaccacctgtgaaccgaccccaaaagaggcacacccatctctgagcactcccgatccatgtcaaacccaggtaaggttctacgcgttgcatcgaattaatccgcatgctccgccgcttgtgcggggccccgtcaattcctttgagttttagccttgcggccgtactccccaggcggggtacttaaagcgttagctacggcacggaacccgtggaatggaccccacacctagtacccaccgtttacagcgtggactaccagggtatctaagcctgttcgctccccacgctttcgctcctcagcgtcag

SEQ ID NO: 200 - DNA, 494 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
agagtttgatcctggctcagagcgaacgctggcggcaggcttaacacatgcaagtcgagcgggcatagcaatatgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcattgctc

SEQ ID NO: 201 - DNA, 627 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
ttcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccacgaggaaggtgggtatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtaaccaagggcgaattccacagtggatatcaagcttatcgataccgtcgacctcgagggggggcccggtacccagctt

SEQ ID NO: 202 - DNA, 493 bp, Unknown
  Kingdom: Bacteria, Phylum: Firmicutes, Class: Bacilli, Order: Lactobacillales, Family: Streptococcaceae, Genus: Streptococcus
agagtttgatcctggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataagagtagatgttgcatgacatttacttaaaaggtgcaattgcatcactaccagatggacctgcgttgtattagctagttggtgggataacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttacca

SEQ ID NO: 203 - DNA, 660 bp, Unknown
  Kingdom: Bacteria, Phylum: Firmicutes, Class: Bacilli, Order: Lactobacillales, Family: Streptococcaceae, Genus: Streptococcus
tgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtaaccaagggcgaattccacagtggatatcaagcttatcgataccgtcgacctcgagggggggcccggtacccagc

SEQ ID NO: 204 - DNA, 594 bp, Unknown
  Kingdom: Bacteria, Phylum: Firmicutes, Class: Bacilli, Order: Lactobacillales, Family: Streptococcaceae, Genus: Streptococcus
  misc_feature (565)..(565): n is a, c, g, or t
agagtttgatcctggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataagagtagatgttgcatgacatttacttaaaaggtgcaattgcatcactaccagatggacctgcgttgtattagctagttggtgggataacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattangcgtaaagcgagcgcaggcggttagataa

SEQ ID NO: 205 - DNA, 730 bp, Unknown
  Kingdom: Bacteria, Phylum: Firmicutes, Class: Bacilli, Order: Lactobacillales, Family: Streptococcaceae, Genus: Streptococcus
tagtgccgtagctaacgcattaagcactccgcctggggagtacgaccgcaaggttgaaactcaaaggaattgacgggggcccgcacaagcggtggagcatgtggtttaattcgaagcaacgcgaagamccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtaaccaagggcgaattccacagtggatatcaagcttatcgataccgtcgacctcgagggggggcccggtacccagc

SEQ ID NO: 206 - DNA, 857 bp, Unknown
  Kingdom: Bacteria, Phylum: candidate division WPS-2, Class: Incertae sedis, Order: Incertae sedis, Family: Incertae sedis, Genus: WPS-2 genera incertae sedis
catctatttgccgtttgcacagcaggatcctgtcgcaagtggcatggggctaggattgtcgctggtgaagcgcaatgttgatagccttggaggcacagtcgatattgagaccgatcaggcttttggcaccacggcaacaatctctcttcggactagggatattgtcgcggaaacggacacgcacttagaggccgacagcaaaagtcaaattcccgcaggaatcataccatcaatgccgaagcgaccaaaagacagtttgcctgtcatgcacgcctgcttttacgctccaagcacgtggctacatcgccacgacaagagggatgagcgatccattgatctggtattcgactcgctggccagcacactgggcgagtggtaccagccggtactcagcctatggcaacgccagaagaagcatactatcccggatttgatcttcatcagccaacggaacttggcagagttcaaggaggaatgcggaaaagagttcgccaatgtcaagaaagttgtgatctgcgccgcgattggcaagaacagctcacaagatcgagagaggatacgtcaggcttcgactgttgcagatgctctgatcacgggtgcggtgttgccgtcgaagctctgggaagttgttacgagctactttccacgaattcttcagcctgaggcctctgctgacgaccagacacgcaacaacaagaacactggcatccggcccaagtccctgggctccgatgaatcgagagaggcggtcaatgaacaaaagaaggacagtgacagcttgcccagacatgtgcttccggagcatgatcttgagaatgaacagtcgtcccataacgacagtgataagcaggtccccg

SEQ ID NO: 207 - DNA, 627 bp, Unknown
  Kingdom: Bacteria, Phylum: Proteobacteria, Class: Alphaproteobacteria, Order: Rhizobiales, Family: Bradyrhizobiaceae, Genus: Afipia
ggttaccttgttacgacttcaccccagtcgctgaccctaccgtggtcagctgccccccttgcgggttagcgcactgccttcaggtagaaccaactcccatggtgtgacgggcggtgtgtacaaggcccgggaacgtattcaccgtggcatgctgatccacgattactagcgattccaacttcatgggctcgagttgcagagcccaatccgaactgagacggctttttgagatttgcgaggggtcgcccctttgcatcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggttgcgctcgttgcgggacttaacccaacatctcacgacacgagctgacgacaaccatgcagcacctgtgctctatgccccgaagggaaggctccatctctggtgccggtcatagacatgtcaagggctggtaaggttctgcgcgttgcgtcgaattaaaccacatgctccaccgcttgtgcgggcccccgtcaattcctttgagttttaatcttgcgaccgtactcc

SEQ ID NO: 208 - DNA, 616 bp, Unknown
  Kingdom: Bacteria, Phylum: Proteobacteria, Class: Alphaproteobacteria, Order: Rhizobiales, Family: Bradyrhizobiaceae, Genus: Rhodopseudomonas
  misc_feature (20)..(20): n is a, c, g, or t
ctctgacttaaaaacccgcntacgcaccctttacgcccagtgattccgagcaacgctagcccccttcgtattaccgcggctgctggcacgaagttagccggggcttattcttacggtaccgtcattatcttcccgtacaaaagagctttacaaccctagggccttcatcactcacgcggcatggctggatcaggcttgcgcccattgtccaatattccccactgctgcctcccgtaggagtttgggccgtgtctcagtcccaatgtggctgatcatcctctcagaccagctactgatcgtcgccttggtaggccattaccctaccaactagctaatcagacgcgggccgatctttcggcgataaatctttccccgttagggcttatccggtattagctgaagtttccctcagttgttccgaaccaaaaggtacgttcccacgcgttactcacccgtctgccactgacaccgaagtgcccgttcgacttgcatgtgttaagcctgccgccagcgttcgctctgagccaggatcaaactctaagggcgaattccacagtggatatcaagcttatcgataccgtcgacctcgagggggggcccggtacccagctttgtc

SEQ ID NO: 209 - DNA, 660 bp, Unknown
  Kingdom: Bacteria, Phylum: Firmicutes, Class: Bacilli, Order: Lactobacillales, Family: Streptococcaceae, Genus: Streptococcus
agagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcag

SEQ ID NO: 210 - DNA, 664 bp, Unknown
  Kingdom: Bacteria, Phylum: Firmicutes, Class: Bacilli, Order: Lactobacillales, Family: Streptococcaceae, Genus: Streptococcus
acgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcagtgaggtaaccttttggagccagccgcctaaggtgggatagatgattggggtgaagtcgtaacaaggtaaccaagggcgaattccacagtggatatcaagcttatcgataccgtcgacctcgagggggggcccggtacccagctttgtc

SEQ ID NO: 211 - DNA, 716 bp, Unknown
  Kingdom: Bacteria, Phylum: Cyanobacteria, Class: Incertae sedis, Order: Incertae sedis, Family: Incertae sedis, Genus: Incertae sedis
ggttaccttgttacgacttcactccagtcactagccctgccttcggcatccccccccttgtggttaaggtaacgacttcgggcatggccagcttccatagtgtgacgggcggtgtgtacaaggcccgggaacgaattcaccgccgtatggctgaccggcgattactagcgattccgacttcatgcaggcgagttgcagcctgtaatccgaactgaggacaggtttttgaagttagctcaccctcgcgggattgcgatcctttgtcccgcccattgtagcacgtgtgtcgcccagggcataaggggcatgatgacttgacgtcatcctcaccttcctccggcttatcaccggcagtctgctcagggttccaaacctaacggtggcaactaaacacgagggttgcgctcgttgcgggacttaacccaacaccttacggcacgagctgacgacagccatgcaccacctgtgtccgcgttcccgaaggcacccctctctttcaagaggattcgcggcatgtcaagccctggtaaggttcttcgctttgcatcgaattaaaccacatgctccaccgcttgtgcgggcccccgtcaattcctttgagtttcattcttgcgaacgtactccccaggcgggatacttaacgcgttagctacagcactgcacgggtcggtatacgcacagcgcctagtatccatcgtttacggctaggactactg

SEQ ID NO: 212 - DNA, 652 bp, Unknown
  Kingdom: Bacteria, Phylum: Cyanobacteria, Class: Incertae sedis, Order: Incertae sedis, Family: Incertae sedis, Genus: Incertae sedis
caccggaaattccctctgcccctaccgtactccagcttagtagtttccaccgcctgtccagggttgagccctgggatttgacggcggacttaaaaagccacctacagacgctttacgcccaatcattccggataacgcttgcatcctctgtcttaccgcggctgctggcacagagttagccgatgcttattccccagataccgtcattgtttcttctctgggaaaagaagttcacgacccgtgggccttctacctccacgcggcattgctccgtcaggctttcgcccattgcggaaaattccccactgctgcctcccgtaggagtctgggccgtgtctcagtcccagtgtggctgatcatcctctcggaccagctactgatcatcgccttggtaagctattacctcaccaactagctaatcagacgcgagcccctcctcaggcggattcctccttttgctcctcagcctacggggtattagcagccgtttccagctgttgttcccctcccaagggcaggttcttacgcgttactcacccgtccgccactggaaacaccacttcccgtccgacttgcatgtgttaagcatgccgccagcgttcatcctgagccaggatcaaactctaagggcgaattccacagtggatatcaa

SEQ ID NO: 213 - DNA, 627 bp, Unknown
  Kingdom: Bacteria, Phylum: Proteobacteria, Class: Gammaproteobacteria, Order: Pseudomonadales, Family: Pseudomonadaceae, Genus: Pseudomonas
agagtttgatcctggctcagattgaacgctggcggcaggcctaacacatgcaagtcgagcggatgagaagagcttgctcttcgattcagcggcggacgggtgagtaatacctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaa

SEQ ID NO: 214 - DNA, 662 bp, Unknown
  Kingdom: Bacteria, Phylum: Proteobacteria, Class: Gammaproteobacteria, Order: Pseudomonadales, Family: Pseudomonadaceae, Genus: Pseudomonas
cgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtaaccaagggcgaattccacagtggatatcaagct

SEQ ID NO: 215 - DNA, 651 bp, Unknown
  Kingdom: Bacteria, Phylum: Firmicutes, Class: Bacilli, Order: Lactobacillales, Family: Lactobacillaceae, Genus: Lactobacillus
agagtttgatcctggctcaggacgaacgctggcggcgtgcctaatacatgcaagtcgagcgagtctgccttgaagatcggagtgcttgcactctgtgaaacaagatacaggctagcggcggacgggtgagtaacacgtgggtaacctgcccaagagatcgggataacacctggaaacagatgctaataccggataacaacagatgatgcctatcaactgtttaaaagatggttctgctatcactcttggatggacctgcggtgcattagctagttggtagggtaacggcctaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttgttggtgaagaaggacaggggtagtaactgacctttgtttgacggtaatcaattagaaagtcacggctaactacgtgccagcagccgcggtaatacgtaggtggcaagcgttgtccggatttattgggcgtaaagcgagtgcaggcggctcgataagtctgatgtgaaagccttcggctcaaccggaga

SEQ ID NO: 216 - DNA, 666 bp, Unknown
  Kingdom: Bacteria, Phylum: Firmicutes, Class: Bacilli, Order: Lactobacillales, Family: Lactobacillaceae, Genus: Lactobacillus
tgacgggggcccgcacaagcggtggagcatgtggtttaattcgaagcaacgcgaagaaccttaccaggtcttgacatccatagccagtctaagagattagatgttcccttcggggactatgagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacggtacaacgagaagcgaccctgtgaaggcaagcggatctctgaaagccgttctcagttcggattgcaggctgcaactcgcctgcatgaggctggaatcgctagtaatcgcaaatcagcacgttgcggtgaatacgttcccgggccttgtacacaccgcccgtcacaccatgagagtctgtaacgcccgaagccggcgggataaccaaaaggagtcagccgtctaaggcgggacagatgattagggtgaagtcgtaacaaggtaaccaagggcgaattccacagtggatatcaagcttatcgataccgtcgacctcgagggggggcccggtacccagctttgtc

SEQ ID NO: 217 - DNA, 699 bp, Unknown
  Kingdom: Bacteria, Phylum: Cyanobacteria, Class: Incertae sedis, Order: Incertae sedis, Family: Incertae sedis, Genus: Incertae sedis
agagtttgatcctggctcaggatgaacgctggcggcatgcttaacacatgcaagtcggacgggaagtggtgtttccagtggcggacgggtgagtaacgcgtaagaacctgcccttgggaggggaacaacagctggaaacggctgctaataccccgtaggctgaggagcaaaaggaggaatccgcctgaggaggggctcgcgtctgattagctagttggtgaggtaatagcttaccaaggcgatgatcagtagctggtccgagaggatgatcagccacactgggactgagacacggcccagactcctacgggaggcagcagtggggaattttccgcaatgggcgaaagcctgacggagcaatgccgcgtggaggtagaaggcccacgggtcgtgaacttcttttcccagagaagaaacaatgacggtatctggggaataagcatcggctaactctgtgccagcagccgcggtaagacagaggatgcaagcgttatccggaatgattgggcgtaaagcgtctgtaggtggctttttaagtccgccgtcaaatcccagggctcaaccctggacaggcggtggaaactactaagctggagtacggtaggggcagagggaatttccggtggagcggtgaaatgcgtagagatcggaaagaacaccaacggcgaaagcgctctgctgggccgacactggcactga

SEQ ID NO: 218 - DNA, 702 bp, Unknown
  Kingdom: Bacteria, Phylum: Cyanobacteria, Class: Incertae sedis, Order: Incertae sedis, Family: Incertae sedis, Genus: Incertae sedis
gggagtacgttcgcaagaatgaaactcaaaggaattgacgggggcccgcacaagcggtggagcatgtggtttaattcgatgcaaagcgaagaaccttaccagggcttgacatgccgcgaatcctcttgaaagagaggggtgccttcgggaacgcggacacaggtggtgcatggctgtcgtcagctcgtgccgtaaggtgttgggttaagtcccgcaacgagcgcaaccctcgtgtttagttgccaccgttaggtttggaaccctgagcagactgccggtgataagccggaggaaggtgaggatgacgtccagtcatcatgccccttatgccctgggcgacacacgtgctacaatgggcgggacaaaggatcgcaatcccgcgagggtgagctaacttcaaaaacctgtcctcagttcggattgcaggctgcaactcgcctgcatgaagtcggaatcgctagtaatcgccggtcagccatacggcggtgaattcgttcccgggccttgtacacaccgcccgtcacactatggaagctggccatgcccgaagtcgttaccttaaccacaaggggggggatgccgaaggcagggctagtgactggagtgaagtcgtaacaaggtaaccaagggcgaattccacagtggatatcaagcttatcgataccgtcgacctcgagggggggcccggtacccagctttgtc

SEQ ID NO: 219 - DNA, 536 bp, Unknown
  Kingdom: Bacteria, Phylum: Firmicutes, Class: Bacilli, Order: Lactobacillales, Family: Streptococcaceae, Genus: Streptococcus
agagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcatgaaattgcttatcgcatgataattaattgaaagatgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatac

SEQ ID NO: 220 - DNA, 660 bp, Unknown
  Kingdom: Bacteria, Phylum: Firmicutes, Class: Bacilli, Order: Lactobacillales, Family: Streptococcaceae, Genus: Streptococcus
gggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtaaccaagggcgaattccacagtggatatcaagcttatcgataccgtcgacctcgagggggggcccggtacccagctttgtc

SEQ ID NO: 221 - DNA, 688 bp, Unknown
  Kingdom: Bacteria, Phylum: Proteobacteria, Class: Alphaproteobacteria, Order: Rhizobiales, Family: Rhizobiaceae, Genus: Rhizobium
agagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggatttactgggcgtaaagcgcacgtaggcggatcgatcagtcaggggtgaaatcccagggctcaaccctggaactgcctttgatactgtcgatctggagtatggaagaggtaagtggaattccgagtgtagaggtgaaattcgtagatattcggaggaacaccagtggcgaaggcggcttactggtccattactgac

SEQ ID NO: 222 - DNA, 643 bp, Unknown
  Kingdom: Bacteria, Phylum: Proteobacteria, Class: Alphaproteobacteria, Order: Rhizobiales, Family: Rhizobiaceae, Genus: Rhizobium
agcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcatccagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgagtacgttcccgggccttgtacacaccgcccgtcacaccatgggagttggttttacccgaaggtagtgcgctaaccgcaaggaggcagctaaccacggtagggtcagcgactggggtgaagtcgtaacaaggtaaccaagggcgaattccacagtggatatcaagcttatcgataccgtcgacctcgagggggggcccggtacccagc

SEQ ID NO: 223 - DNA, 662 bp, Unknown
  Kingdom: Bacteria, Phylum: Proteobacteria, Class: Alphaproteobacteria, Order: Rhizobiales, Family: Rhizobiaceae, Genus: Rhizobium
agagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggatttactgggcgtaaagcgcccgtaggcggatcgatcagtcaggggtgaaatcccagggctcaaccctggaactgcctttgatactgtcgatctggagtatggaagaggtaagtggaattccgagtgtagaggtgaaattcgtagatattcggaggaacaccagtggcga

SEQ ID NO: 224 - DNA, 626 bp, Unknown
  Kingdom: Bacteria, Phylum: Proteobacteria, Class: Alphaproteobacteria, Order: Rhizobiales, Family: Rhizobiaceae, Genus: Rhizobium
aaggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggctaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtaaccaagggcgaattccacagtggatatcaagct

SEQ ID NO: 225 - DNA, 661 bp, Unknown
  Kingdom: Bacteria, Phylum: Firmicutes, Class: Bacilli, Order: Lactobacillales, Family: Streptococcaceae, Genus: Streptococcus
agagtttgatcctggctcaggacgaacgctggcggcgtgcctaacacatgcaagtagaacgctgaagagaggagcttgctcttcttggatgagttgcgaacgggtgagtaacgcgtaggtagcctgcctggtagcgggggataactattggaaacgatagctaataccgcatgaaattgcttatcgcatgataattaattgaaagatgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtatgctttggaaactgtttaacttgagtgcaga

SEQ ID NO: 226 - DNA, 663 bp, Unknown
  Kingdom: Bacteria, Phylum: Firmicutes, Class: Bacilli, Order: Lactobacillales, Family: Streptococcaceae, Genus: Streptococcus
cgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtaaccaagggcgaattccacagtggatatcaagcttatcgataccgtcgacctcgagggggggcccggtacccagctttgtc

SEQ ID NO: 227 - DNA, 696 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
ggttaccttgttacgacttcaccccagtcgctgaccctaccgtggccggctgccccctttcggttagcgcaccgtcttcaggtaaaaccaactcccatggtgtgacgggcggtgtgtacaaggcccgggaacgtattcaccgtggcgtgctgatccacgattactagcgattccaacttcatgggctcgagttgcagagcccaatccgaactgagacggctttttgagatttgcgaagggtcgccccttagcatcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggttgcgctcgttgcgggacttaacccaacatctcacgacacgagctgacgacagccatgcagcacctgtctccggtccagccgaactgaagaactccgtctctggagtccgcgaccgggatgtcaagggctggtaaggttctgcgcgttgcgtcgaattaaaccacatgctccaccgcttgtgcgggcccccgtcaattcctttgagttttaatcttgcgaccgtactccccaggcggaatgcttaaagcgttagctgcgccactagtgagtaaacccactaacggctggcattcatcg

SEQ ID NO: 228 - DNA, 597 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
ggcagttctggagttgagctccaggatttcacccctgacttaaagacccgcctacgcaccctttacgcccagtgattccgagcaacgctagcccccttcgtattaccgcggctgctggcacgaagttagccggggcttattcttgcggtaccgtcattatcttcccgcacaaaagagctttacaaccctagggccttcatcactcacgcggcatggctggatcaggcttgcgcccattgtccaatattccccactgctgcctcccgtaggagtttgggccgtgtctcagtcccaatgtggctgatcaccctctcagaccagctactgatcgtcgccttggtgagccattacctcaccaactagctaatcagacgcgggccgatctttcggcgataaatctttccccgtaagggcttatccggtattagcacaagtttccctgtgttgttccgaaccaaaaggtacgttcccacgcgttactcacccgtctgccgctgacatattgctatgcccgctcgacttgcatgtgttaagcctgccgccagcgttcgctctgagccaggatcaaactctaagggcgaattccacagtggatat

SEQ ID NO: 229 - DNA, 682 bp, Unknown
  Kingdom: Bacteria, Phylum: Proteobacteria, Class: Alphaproteobacteria, Order: Rhizobiales, Family: Rhizobiaceae, Genus: Rhizobium
ggttaccttgttacgacttcaccccagtcgctgaccctaccgtggttagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcacactcgcgtgctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctgcgccaccgaagtggaccccatatctctacgggtaacacaggatgtcaagggctggtaaggttctgcgcgttgcttcgaattaaaccacatgctccaccgcttgtgcgggcccccgtcaattcctttgagttttaatcttgcgaccgtactccccaggcggaatgtttaatgcgttagctgcgccaccgaacagtatactgcccgacggcta

SEQ ID NO: 230 - DNA, 662 bp, Unknown
  Kingdom: Bacteria, Phylum: Proteobacteria, Class: Alphaproteobacteria, Order: Rhizobiales, Family: Rhizobiaceae, Genus: Rhizobium
actccagatcgacagtatcaaaggcagttccagggttgagccctgggatttcacccctgactgatcgatccgcctacgtgcgctttacgcccagtaaatccgaacaacgctagcccccttcgtattaccgcggctgctggcacgaagttagccggggcttcttctccggataccgtcattatcttctccggtgaaagagctttacaaccctagggccttcatcactcacgcggcatggctggatcaggcttgcgcccattgtccaatattccccactgctgcctcccgtaggagtttgggccgtgtctcagtcccaatgtggctgatcatcctctcagaccagctatggatcgtcgccttggtaggcctttaccccaccaactagctaatccaacgcgggctcatcctttcccgataaatctttctcccgaaggacacatacggtattagcacaagtttccctgcgttattccgtagaaaagggtagattcccacgcgttactcacccgtctgccgctccccttgcggggcgctcgacttgcatgtgttaagcctgccgccagcgttcgttctgagccaggatcaaactctaagggcgaattccacagtggatatcaagctgatcgataccgtcgacctcgagggggggcccggtacccagc

SEQ ID NO: 231 - DNA, 653 bp, Unknown
  Kingdom: Bacteria, Phylum: Proteobacteria, Class: Betaproteobacteria, Order: Burkholderiales, Family: Burkholderiaceae, Genus: Polynucleobacter
agagtttgatcctggctcagattgaacgctggcggcatgccttacacatgcaagtcgaacggcagcacgggtgcttgcacctggtggcgagtggcgaacgggtgagtaatacatcggaacgtaccttatcgtgggggataacgcagcgaaagttgcgctaataccgcatacgccctgagggggaaagcgggggaccgtaaggcctcgcgcgattagagcggccaatgtctgattagcttgttggtgaggtaaaagcttaccaaggcgatgatcagtagctggtctgagaggacgatcagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacagcagctctaacacagtctgcgaatgacggtacctgaagaataagcaccggctaactacgtgccagcagccgcggtaatacgtagggtgcgagcgttaatcggaattactgggcgtaaagcgtgcgcaggcggttatacaagacaggcgtgaaatccccgggcttaacctgggaatggcgtctgtgactgtatagctagagtgtgtcaga

SEQ ID NO: 232 - DNA, 666 bp, Unknown
  Kingdom: Bacteria, Phylum: Proteobacteria, Class: Betaproteobacteria, Order: Burkholderiales, Family: Burkholderiaceae, Genus: Polynucleobacter
tgaagtcagccgcctggggagtacggtcgcaagattaaaactcaaaggaattgacggggacccgcacaagcggtggatgatgtggattaattcgatgcaacgcgaaaaaccttacctacccttgacatgtcactaacgaagtagagatacattaggtgcccgtaagggaaagtgaacacaggtgctgcatggctgtcgtcagctcgtgtcgtgagatgttgggttaagtcccgcaacgagcgcaacccttgtctttagttgctacgcaagagcactctaaagagactgccggtgacaaaccggaggaaggtggggatgacgtcaagtcctcatggcccttatgggtagggcttcacacgtcatacaatggtgcgtacagagggttgccaacccgcgagggggagctaatctcttaaaacgcatcgtagtccggatcgtagtctgcaactcgactacgtgaggctggaatcgctagtaatcgcggatcagcatgtcgcggtgaatacgttcccgggtcttgtacacaccgcccgtcacaccatgggagtgggttttgccagaagcagttagcctaaccgtaaggagggcgattgccacggcagggttcatgactggggtgaagtcgtaacaaggtaaccaagggcgaattccacagtggatatcaag

SEQ ID NO: 233 - DNA, 623 bp, Unknown
  Kingdom: Bacteria, Phylum: Proteobacteria, Class: Alphaproteobacteria, Order: Rhizobiales, Family: Rhizobiaceae, Genus: Rhizobium
ggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtaaccaagggcgaattccacagtggatatcaagc

SEQ ID NO: 234 - DNA, 711 bp, Unknown
  Kingdom: Bacteria, Phylum: Bacteroidetes, Class: Sphingobacteriia, Order: Sphingobacteriales, Family: Chitinophagaceae, Genus: Filimonas
cgttgagatttgttctatttctacttatactcaggatcaatcttgcatttatcttacaatctatgtattttccacaactgcatgcactagttaccccagatctgtaaagtggatcccgatccaccaatgaaacgcgccaaggcgatcttacgcaggagccaagtctcatagtatctcgatctggtcaggcactatacctgttatttggtcaagcctgtggaatcattgcgttgactaatcttaaggggcatatgaagaatgaactatgtgatcagatgatttaaaagaaatacaacctttgttattggtaggtattatgaaggtgaacttgtagtttgtgggtcgcgctgtcttactactttaaaaaggttgttactgcggcaccaaaagttattgctacacctcactatccgtattcggacttggtctgaagttgtataccagaaaacttactacgcaacatctcacctgggcaggtatgtacggagtgctcaccaggagctaaaagccaaaggacacaagaattttatccacactgaaacaagaaaaaagcaacgggacacaagaaacgcacaaataataagccatgaaacacaaaacagaccactccttgtctgcaaacttggtttgagataacaccggaaacgaaacacggatttatggttagcagacacatcgactaggagcgatagtcaagccaaggtaccattg

SEQ ID NO: 235 - DNA, 917 bp, Unknown
  Kingdom: Bacteria, Phylum: Bacteroidetes, Class: Sphingobacteriia, Order: Sphingobacteriales, Family: Chitinophagaceae, Genus: Filimonas
cccaatgtggaattcgcccttgttacgacttcaccccagtttccgacatcgcttatgcaggttagtcagcgagatctgatcgccactaatgacgtctgcacggcacgggattcattaaaccaggtggagcctttcttcctgcgttgagatttgttctatttctacttatactcaggatcaatcttgcatttatcttacaatctatgtattttccacaactgcatgcactagttaccccagatctgtaaagtggatcccgatccaccaatgaaacgcgccaaggcgatcttacgcaggagccaagtctcatagtatctcgatctggtcaggcactatacctgttatttggtcaagcctgtggaatcattgcgttgactaatcttaaggggcatatgaagaatgaactatgtgatcagatgatttaaaagaaatacaacctttgttattggtaggtattatgaaggtgaacttgtagtttgtgggtcgcgctgtcttactactttaaaaaggttgttactgcggcaccaaaagttattgctacacctcactatccgtatccggacttggtctgaagttgtataccagaaaacttactacgcaacatctcacctgggcaggtatgtacggagtgctcaccaggagctaaaagccaaaggacacaagaattttatccacactgaaacaagaaaaaagcaacgggacacaagaaacgcacaaataataagccatgaaacacaaaacagaccactccttgtctgcaaacttggtttgagataacaccggaaacgaaacacggatttatggttagcagacacatcgactaggagcgatagtcaagccaaggtaccattgatggggcgcgtcttccaatctgagccatgatcaaactaagggcgaattccacagtggatatcaag

SEQ ID NO: 236 - DNA, 709 bp, Unknown
  Kingdom: Bacteria, Phylum: Bacteroidetes, Class: Sphingobacteriia, Order: Sphingobacteriales, Family: Chitinophagaceae, Genus: Filimonas
accaagtttgcagacaaggagtggtctgttttgtgtttcatggcttattatttgtgcgtttcttgtgtcccgttgcttttttcttgtttcagtgtggataaaattcttgtgtcctttggcttttagctcctggtgagcactccgtacatacctgcccaggtgagatgttgcgtagtaagttttctggtatacaacttcagaccaagtccgaatacggatagtgaggtgtagcaataacttttggtgccgcagtaacaacctttttaaagtagtaagacagcgcgacccacaaactacaagttcaccttcataatacctaccaataacaaaggttgtatttcttttaaatcatctgatcacatagttcattcttcatatgccccttaagattagtcaacgcaatgattccacaggcttgaccaaataacaggtatagtgcctgaccagatcgagatactatgagacttggctcctgcgtaagatcgccttggcgcgtttcattggtggatcgggatccactttacagatctggggtaactagtgcatgcagttgtggaaaatacatagattgtaagataaatgcaagattgatcctgagtataagtagaaatagaacaaatctcaacgcaggaagaaaggctccacctggtttaatgaatcccgtgccgtgcagacgtcattagtggcgatcagatctcgctgactaacc

SEQ ID NO: 237 - DNA, 253 bp, Pantoea agglomerans
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 238 - DNA, 253 bp, Unknown
  Kingdom: Bacteria, Phylum: Proteobacteria, Class: Gammaproteobacteria, Order: Enterobacteriales, Family: Enterobacteriaceae, Genus: Enterobacter
tacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggagtagcggtgaaatgcgtagagatctggaggaataccggtggcgaaggcggccccctggacgaagactgacgctcaggtgcgaaagcgtggggagcaaacagg

SEQ ID NO: 239 - DNA, 253 bp, Unknown
  Kingdom: Bacteria, Phylum: Firmicutes, Class: Bacilli, Order: Lactobacillales, Family: Leuconostocaceae, Genus: Leuconostoc
tacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacagg

SEQ ID NO: 240 - DNA, 253 bp, Clostridium butyricum
tacgtaggtggcaagcgttgtccggatttactgggcgtaaagggagcgtaggtggatatttaagtgggatgtgaaatactcgggcttaacttgagtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 241 - DNA, 253 bp, Bacillus firmus
tacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 242 - DNA, 253 bp, Bacillus ginsengihumi
tacgtaggtggcaagcgttgtccggaattattgggcgtaaagcgcgcgcaggcggtcttttaagtctgatgtgaaagcccacggctcaaccgtggagggtcattggaaactggaagacttgagtgcggaagaggagagtggaattccacgtgtagcggtgaaatgcgtagagatgtggaggaacaccagtggcgaaggcgactctctggtctgtaactgacgctgaggcgtgaaagcgtggggagcaaacagg

SEQ ID NO: 243 - DNA, 253 bp, Bacillus flexus
tacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacagg

SEQ ID NO: 244 - DNA, 253 bp, Weissella ghanensis
tacgtatgtcccaagcgttatccggatttattgggcgtaaagcgagcgcaggcggttatttaagtctgatgtgaaagcctacggctcaaccgtagaattgcatcggaaactggatgacttgagtgcagtagaggagagtggaactccatgtgtagcggtgaaatgcgtagatatatggaagaacaccagaggcgaaggcggctctctggactgtaactgacgctgaggctcgaaagtgtgggtagcaaacagg

SEQ ID NO: 245 - DNA, 252 bp, Unknown
  Kingdom: Bacteria, Phylum: Firmicutes, Class: Bacilli, Order: Bacillales, Family: Paenibacillaceae, Genus: Paenibacillus
tacgtagggggcaagcgttgtccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 246 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacagg

SEQ ID NO: 247 - DNA, 252 bp, Unknown
  Kingdom: Bacteria, Phylum: Firmicutes, Class: Bacilli, Order: Lactobacillales, Family: Streptococcaceae, Genus: Lactococcus
tacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacagg

SEQ ID NO: 248 - DNA, 252 bp, Unknown
  Kingdom: Bacteria, Phylum: Firmicutes, Class: Bacilli, Order: Bacillales, Family: Paenibacillaceae, Genus: Paenibacillus
tacgtagggggcaagcgttgtccggaattattgggcgtaaagcgcgcgcaggcggctttttaagtccggtgtcacagcccaaggctcaaccttgggtcgcactggaaactggagagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 249 - DNA, 253 bp, Unknown
  Kingdom: Bacteria, Phylum: Firmicutes, Class: Bacilli, Order: Bacillales, Family: Exiguobacteraceae, Genus: Exiguobacterium
tacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 250 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacagg

SEQ ID NO: 251 - DNA, 253 bp, Pseudomonas fragi
tacagagggtgcaagcgttaatcggaattactaggcgtaaagcgcgcgtaggtggtttgttaagtcggatgtgaaatccccgggctcaacctgggaactgcatccgaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacagg

SEQ ID NO: 252 - DNA, 253 bp, Unknown
  Kingdom: Bacteria, Phylum: Proteobacteria, Class: Betaproteobacteria, Order: Burkholderiales, Family: Oxalobacteraceae, Genus: Janthinobacterium
tacgtagggtgcaagcgttaatcggaattactgggcgtaaagcgtgcgcaggcggttttgtaagtctgtcgtgaaagccccgggctcaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 253 - DNA, 252 bp, Paenibacillus amylolyticus
tacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacagg

SEQ ID NO: 254 - DNA, 252 bp, Unknown
  Kingdom: Bacteria, Phylum: Firmicutes, Class: Bacilli, Order: Bacillales, Family: Paenibacillaceae
tacgtagggggcaagcgttgtccggaattattgggcgtaaagcgcgtgcaggcggcttcttaagtcgggtgtttaagaccggggctcaaccccggctcgcacccgaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 255 - DNA, 253 bp, Unknown
  Kingdom: Bacteria, Phylum: Proteobacteria, Class: Gammaproteobacteria, Order: Pseudomonadales, Family: Pseudomonadaceae
tacagagggtgcaagcgttaatcggaattactgggcgtaaagcgcgcgtaggtggtttgttaagttggatgtgaaagccccgggctcaacctgggaactgcatccaaaactggcaggctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 256 - DNA, 253 bp, Unknown
  Kingdom: Bacteria, Phylum: Firmicutes, Class: Bacilli, Order: Bacillales, Family: Bacillaceae, Genus: Bacillus
tacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 257 - DNA, 253 bp, Pseudomonas viridiflava
tacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgagagcgtggggagcaaacagg

SEQ ID NO: 258 - DNA, 253 bp, Unknown
  Kingdom: Bacteria, Phylum: Proteobacteria, Class: Betaproteobacteria, Order: Burkholderiales, Family: Oxalobacteraceae
tacgtagggtgcgagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgagtagcagtgaaatgcgtagagatgtggaggaacaccgatggcgaaggcagccccctgggtcaagactgacgctcatgcacgaaagcgtggggagcaaacagg

SEQ ID NO: 259 - DNA, 253 bp, Unknown
  Kingdom: Bacteria, Phylum: Bacteroidetes, Class: Flavobacteriia, Order: Flavobacteriales, Family: Weeksellaceae, Genus: Chryseobacterium
tacggagggtgcaagcgttatccggatttattgggtttaaagggtccgtaggcggactcgtaagtcagtggtgaaatctcacagctcaactgtgaaactgccattgatactgcgggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 260 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacggagggggctagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 261 - DNA, 253 bp, Unknown
  Kingdom: Bacteria, Phylum: Proteobacteria, Class: Betaproteobacteria, Order: Burkholderiales, Family: Burkholderiaceae, Genus: Burkholderia
tacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 262 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacagagggtgcaagcgttaatcggaattactgggcgtaaagcgcgcgtaggcggtttgtcaagtcggatgtgaaatccccgggctcaacctgggaactgcatccgaaactggcaagctagagtatggtagagggtggtggaatttcctgtgtagcggtgaaatgcgtagatataggaaggaacaccagtggcgaaggcgaccatctgggctcatactgacactgaggtgcgaaagcgtggggagcaaacagg

SEQ ID NO: 263 - DNA, 253 bp, Bacillus cereus
tacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacagg

SEQ ID NO: 264 - DNA, 253 bp, Unknown
  Kingdom: Bacteria, Phylum: Proteobacteria, Class: Betaproteobacteria, Order: Burkholderiales, Family: Oxalobacteraceae
tacgtagggtgcaagcgttaatcggaattactgggcgtaaagcgtgcgcaggcggttttgtaagtctgacgtgaaatccccgggcttaacctgggaatggcgttggagactgcaaggctggaatctggcagaggggggtagaattccacgtgtagcagtgaaatgcgtagagatgtggaggaacaccgatggcgaaggcagccccctgggctaagattgacgctcatgcacgaaagcgtggggagcaaacagg

SEQ ID NO: 265 - DNA, 253 bp, Pseudomonas veronii
tacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgagagcgtggggagcaaacagg

SEQ ID NO: 266 - DNA, 253 bp, Unknown
  Kingdom: Bacteria, Phylum: Actinobacteria, Class: Actinobacteria, Order: Actinomycetales, Family: Brevibacteriaceae, Genus: Brevibacterium
tacgtagggtacaagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacagg

SEQ ID NO: 267 - DNA, 253 bp, Unknown
  Kingdom: Bacteria, Phylum: Proteobacteria, Class: Alphaproteobacteria, Order: Rhizobiales, Family: Rhizobiaceae, Genus: Agrobacterium
tacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 268 - DNA, 253 bp, Clostridium intestinale
tacgtaggtggcaagcgttgtccggatttactgggcgtaaagggagcgtaggcggatacttaagtgggatgtgaaatacctgggcttaacttgggtgctgcattccaaactgggtgtctagagtgttggagaggaaagtggaattcctagtgtagcggtgaaatgcgtagagattaggaagaacaccagtggcgaaggcgactttctggacaataactgacgctgaggctcgaaagcgtggggagcaaacagg

SEQ ID NO: 269 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggagctagcgttgttcggaattactgggcgtaaagcgcacgtaggcggctttgtaagttagaggtgaaagcctggagctcaactccagaattgcctttgatactgcatggcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 270 - DNA, 253 bp, Unknown
  Kingdom: Bacteria, Phylum: Firmicutes, Class: Bacilli, Order: Bacillales, Family: Planococcaceae
tacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 271 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacgaagggtgcaagcgttaatcggaattactgggcgtaaagcgcgcgtaggtggtttgccaagttgaatgtgaaatccccgggctcaacctgggaactgcatccaaaactggcaggctagagtatggtagagggtggtggaatttcctgtgtagcggtgaaatgcgtagatataggaaggaacatcagtggcgaaggcgaccacctggactgatactgacactgaggtgcgaaagcgtggggagcaaacagg

SEQ ID NO: 272 - DNA, 253 bp, Unknown
  Kingdom: Bacteria, Phylum: Bacteroidetes, Class: Sphingobacteriia, Order: Sphingobacteriales, Family:
gacgaaggatgcaagcgttatccggattcattgggtttaaagggtgcgtaggcggacctgtaagtcagtggtgaaatctctcagcttaactgagaaactgccattgatactgcaagtctagagtatagatgacgttggcggaatatgacatgtagtggtgaaatacttagatatgtcatagaacaccgattgcgaaggcagctaacgaaactataactgacgctgaggcacgaaagtgcggggatcaaacagg

SEQ ID NO: 273 - DNA, 253 bp, Xanthomonas axonopodis
tacgaagggtgcaagcgttactcggaattactgggcgtaaagcgtgcgtaggtggtggtttaagtctgttgtgaaagccctgggctcaacctgggaattgcagtggatactgggtcactagagtgtggtagagggtagcggaattcccggtgtagcagtgaaatgcgtagagatcgggaggaacatccgtggcgaaggcggctacctggaccaacactgacactgaggcacgaaagcgtggggagcaaacagg

SEQ ID NO: 274 - DNA, 252 bp, Saccharibacillus kuerlensis
tacgtagggggcaagcgttgtccggaattattgggcgtaaagcgcgtgcaggcggcggtttaagtcggatgtttaagatcggggctcaaccccgattcgcatccgaaactgggccgcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 275 - DNA, 253 bp, Unknown
  Kingdom: Bacteria, Phylum: Proteobacteria, Class: Gammaproteobacteria, Order: Pseudomonadales, Family: Pseudomonadaceae
tacagagggtgcaagcgttaatcggaattactgggcgtaaagcgcgcgtaggcggtttgttaagttgaatgtgaaatccccgggctcaacctgggaactgcatccaaaactggcaagctagagtatggtagagggtggtggaatttcctgtgtagcggtgaaatgcgtagatataggaaggaacatcagtggcgaaggcgaccacctggaccaatactgacgctgaggtgcgaaagcgtggggagcaaacagg

SEQ ID NO: 276 - DNA, 253 bp, Unknown
  Kingdom: Bacteria, Phylum: Actinobacteria, Class: Actinobacteria, Order: Actinomycetales, Family: Microbacteriaceae
tacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 277 - DNA, 252 bp, Unknown
  Kingdom: Bacteria, Phylum: Firmicutes, Class: Bacilli, Order: Bacillales, Family: Paenibacillaceae, Genus: Paenibacillus
tacgtaggtggcaagcgttatccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 278 - DNA, 253 bp, Unknown
  Kingdom: Bacteria, Phylum: Proteobacteria, Class: Alphaproteobacteria, Order: Sphingomonadales, Family: Sphingomonadaceae
tacggagggagctagcgttgttcggaattactgggcgtaaagcgcacgtaggcggctttgtaagttagaggtgaaagcctggggctcaactccagaactgcctttaagactgcatcgctagaatccaggagaggtgagtggaattccgagtgtaggggtgaaattcgtagatattcggaagaacaccagtggcgaaggcggcccactggactggtattgacgctgaggtgcgaaagcgtggggagcaaacagg

SEQ ID NO: 279 - DNA, 253 bp, Unknown
  Kingdom: Bacteria, Phylum: Proteobacteria, Class: Alphaproteobacteria, Order: Sphingomonadales, Family: Sphingomonadaceae, Genus: Novosphingobium
tacggagggagctagcgttgttcggaattactgggcgtaaagcgcacgtaggcggttactcaagtcagaggtgaaagcccggggctcaaccccggaactgcctttgaaactaggtaactagaatcctggagaggtgagtggaattccgagtgtagaggtgaaattcgtagatattcggaagaacaccagtggcgaaggcggctcactggacaggtattgacgctgaggtgcgaaagcgtggggagcaaacagg

SEQ ID NO: 280 - DNA, 253 bp, Unknown
  Kingdom: Bacteria, Phylum: Proteobacteria, Class: Alphaproteobacteria, Order: Sphingomonadales, Family: Sphingomonadaceae, Genus: Novosphingobium
tacggagggagctagcgttgttcggaattactgggcgtaaagcgcgcgtaggcggctattcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 281 - DNA, 253 bp, Unknown
  Kingdom: Bacteria, Phylum: Proteobacteria, Class: Alphaproteobacteria, Order: Rhizobiales, Family: Methylobacteriaceae, Genus: Methylobacterium
tacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 282 - DNA, 253 bp, Unknown
  Kingdom: Bacteria, Phylum: Firmicutes, Class: Bacilli, Order: Bacillales, Family: Bacillaceae
tacgtagggggcaagcgttgtccggaattattgggcgtaaagggcgcgtaggcggtttcttaagtctgatgtgaaagcccacagcttaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacagg

SEQ ID NO: 283 - DNA, 253 bp, Unknown
  Kingdom: Bacteria, Phylum: Actinobacteria, Class: Actinobacteria, Order: Actinomycetales, Family: Sanguibacteraceae, Genus: Sanguibacter
tacgtagggcgcaagcgttgtccggaattattgggcgtaaagagctcgtaggcggtttgtcgcgtctggtgtgaaaactcaaggctcaaccttgagcttgcatcgggtacgggcagactagagtgtggtaggggtgactggaattcctggtgtagcggtggaatgcgcagatatcaggaggaacaccgatggcgaaggcaggtcactgggccactactgacgctgaggagcgaaagcatggggagcgaacagg

SEQ ID NO: 284 - DNA, 253 bp, Unknown
  Kingdom: Bacteria, Phylum: Bacteroidetes, Class: Saprospirae, Order: Saprospirales, Family: Saprospiraceae
tacggagggtgcgagcgttatccggaatcactgggtttaaagggtgcgtaggcggttatataagtcagtggtgaaaggccgtcgcttaacgatgggactgccattgatactgtataacttgagagaggttgaggttggcggaatgtggcatgtagcggtgaaatgcttagatataccatagaacaccaattgcgaaggcagctgactagacctcatctgacgctgaggcacgaaagcgtggggagcgaacagg

SEQ ID NO: 285 - DNA, 253 bp, Unknown
  Kingdom: Bacteria, Phylum: Firmicutes, Class: Bacilli, Order: Lactobacillales, Family: Lactobacillaceae
tacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacagg

SEQ ID NO: 286 - DNA, 253 bp, Unknown
  Kingdom: Bacteria, Phylum: Proteobacteria, Class: Alphaproteobacteria, Order: Caulobacterales, Family: Caulobacteraceae, Genus: Mycoplana
tacgaagggggctagcgttgctcggaattactgggcgtaaagggagcgtaggcggacatttaagtcaggggtgaaatcccagagctcaactctggaactgcctttgatactgggtgtcttgagtgtgatagaggtatgtggaactccgagtgtagaggtgaaattcgtagatattcggaagaacaccagtggcgaaggcgacatactggatcattactgacgctgaggctcgaaagcgtggggagcaaacagg

SEQ ID NO: 287 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacagg

SEQ ID NO: 288 - DNA, 253 bp, Escherichia coli
tacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgatgctcaggtgcgaaagcgtggggagcaaacagg

SEQ ID NO: 289 - DNA, 253 bp, Methylobacterium adhaesivum
tacgaagggggctagcgttgctcggaatcactgggcgtaaagggcgcgtaggcggccattcaagtcgggggtgaaagcctgtggctcaaccacagaattgccttcgatactgtttggcttgagtatggcagaggtcagtggaactgcgagtgtagaggtgaaattcgtagatattcgcaagaacaccagtggcgaaggcggctgactgggccattactgacgctgaggcgcgaaagcgtggggagcaaacagg

SEQ ID NO: 290 - DNA, 252 bp, Unknown
  Kingdom: Bacteria, Phylum: Cyanobacteria, Class: , Order: , Family:
gacagaggatgcaagcgttattcagattgactaggtgtaaatcatctgtaggtgcatttcaagtccaccattaaatcctagggctcaaccctaaacaggtggtggaaactactaagctggagtacggtaggggaagagggaatttctggtgaagcggtgaaatgcatagggatcgggaagaacaccaacggcgaaagcactccactaagtcgacactgacattgagagacgaaagcaaggggtgcaaatggg

SEQ ID NO: 291 - DNA, 253 bp, Sphingomonas yabuuchiae
gacggggggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacagg

SEQ ID NO: 292 - DNA, 253 bp, Unknown
  Kingdom: Bacteria, Phylum: Proteobacteria, Class: Gammaproteobacteria, Order: Oceanospirillales, Family: Halomonadaceae, Genus: Halomonas
tacggagggtgcgagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgacactgacactgaggtgcgaaagcgtgggtagcaaacagg

SEQ ID NO: 293 - DNA, 253 bp, Unknown
  Kingdom: Bacteria, Phylum: Proteobacteria, Class: Alphaproteobacteria, Order: Rhizobiales, Family: Methylobacteriaceae
tacgaagggggctagcgttgctcggaatcactgggcgtaaagggcgcgtaggcggctgatttagtcgagggtgaaagcccgtggctcaaccacggaatggccttcgatactgattggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 294 - DNA, 253 bp, Unknown
  Kingdom: Bacteria, Phylum: Proteobacteria, Class: Alphaproteobacteria, Order: Rhizobiales, Family: Aurantimonadaceae
tacgaagggggctagcgttgttcggaattactgggcgtaaagcgcacgtaggcggacatttaagtcaggggtgaaatcccggggctcaaccccggaacggcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacagg

SEQ ID NO: 295 - DNA, 253 bp, Unknown
  Kingdom: Bacteria, Phylum: Bacteroidetes, Class: Sphingobacteriia, Order: Sphingobacteriales, Family: Sphingobacteriaceae, Genus: Pedobacter
tacggaggatccaagcgttatccggatttattgggtttaaagggtgcgtaggcggcccgttaagtcaggggtgaaagacggtagctcaactctcgcagtgcccttgatactgacgggcttgaatggactagaggtaggcggaatgtgacaagtagcggtgaaatgcatagatatgtaacagaacaccgattgcgaaggcagcttactagggttttattgacgctgaggcacgaaagcgtggggatcaaacagg

SEQ ID NO: 296 - DNA, 253 bp, Unknown
  Kingdom: Bacteria, Phylum: Proteobacteria, Class: Deltaproteobacteria, Order: Myxococcales, Family:
gacagagggtgcaaacgttgttcggaattactgggcgtaaagcgcgtgtaggcggctctgcaagtcggatgtgaaatcccacggctcaaccatggaagtgcattcgaaactgcagggctagagtcctggagaggaaggtggaatgcttggtgtagaggtgaaattcgtagatatcaagcggaacaccggtggcgaaggcggccttctggacagtgactgacgctgagacgcgaaagcgtggggagcaaacagg

SEQ ID NO: 297 - DNA, 253 bp, Unknown
  Kingdom: Bacteria, Phylum: Actinobacteria, Class: Actinobacteria, Order: Actinomycetales, Family: Corynebacteriaceae, Genus: Corynebacterium
tacgtagggtgcaagcgttgtccggaattactgggcgtaaagagctcgtaggtggtttgtcgcgtcgtctgtgaaattccggggcttaactccgggcgtgcaggcgatacgggcaaactggagtgctgtaggggagactggaattcctggtgtagcggtgaaatgcgcagatatcaggaggaacaccgatggcgaaggcaggtctctgggcagttactgacgctgaggagcgaaagcatgggtagcgaacagg

SEQ ID NO: 298 - DNA, 252 bp, Unknown
  Kingdom: Bacteria, Phylum: Firmicutes, Class: Bacilli, Order: Lactobacillales, Family: Streptococcaceae, Genus: Streptococcus
tacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacagg

SEQ ID NO: 299 - DNA, 253 bp, Unknown
  Kingdom: Bacteria, Phylum: Firmicutes, Class: Bacilli, Order: Bacillales, Family: Alicyclobacillaceae, Genus: Alicyclobacillus
tacgtagggggcaagcgttgtccggattcactgggcgtaaagcgcgcgcaggcggtgatgtaagtctgaggtgaaaacccgaagctcaacttcgggactgccttggatactgcgtcacttgaggataggagaggcaaggggaattccacgtgtagcggtgaaatgcgtagagatgtggaggaacacctgtggcgaaggcgccttgctggcctatttctgacgctgaggcgcgaaagcgtggggagcaaacagg

SEQ ID NO: 300 - DNA, 253 bp, Unknown
  Kingdom: Bacteria, Phylum: Proteobacteria, Class: Gammaproteobacteria, Order: Enterobacteriales, Family: Enterobacteriaceae
tacggagggtgcaagcgttaatcggaattactgggcgtaaagcgcacgcaggcggtctgtcaagtcggatgtgaaatccccgggctcaacccgggaactgcattcgaaactggcagactcgagtcttgtagaggggggtagaattccaggtgtagcggtgaaatgcgtagagatctggaggaataccggtggcgaaggcggccccctggacaaagactgacgctcaggtgcgagagcgtggggagcaaacagg

SEQ ID NO: 301 - DNA, 253 bp, Unknown
  Kingdom: Bacteria, Phylum: Bacteroidetes, Class: Cytophagia, Order: Cytophagales, Family: Cytophagaceae, Genus: Hymenobacter
tacggagggtgcgagcgttgtccggatttattgggtttaaagggtgcgtaggcggcccgttaagtccggggtgaaagcccgttgctcaacaacggaactgccctggatactgacgggcttgagtacagacgaggttggcggaatggaccgagtagcggtgaaatgcatagatacggtccagaaccccgattgcgaaggcagctgactaggctgttactgacgctgaggcacgacagcgtggggagcgaacagg

SEQ ID NO: 302 - DNA, 253 bp, Unknown
  Kingdom: Bacteria, Phylum: Proteobacteria, Class: Gammaproteobacteria, Order: Xanthomonadales, Family: Xanthomonadaceae, Genus: Xanthomonas
tacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacagg

SEQ ID NO: 303 - DNA, 253 bp, Lactobacillus brevis
tacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacagg

SEQ ID NO: 304 - DNA, 253 bp, Unknown
  Kingdom: Bacteria, Phylum: Proteobacteria, Class: Alphaproteobacteria, Order: Sphingomonadales, Family: Erythrobacteraceae
tacggagggagctagcgttgttcggaattactgggcgtaaagcgcacgtaggcggcgattcaagtcagaggtgaaagcccggggctcaaccccggaactgcctttgaaactagattgctagaatcctggagaggttagtggaattccgagtgtagaggtgaaattcgtagatattcggaagaacaccagtggcgaaggcgactaactggacaggtattgacgctgaggtgcgaaagcgtggggagcaaacagg

SEQ ID NO: 305 - DNA, 253 bp, Methylobacterium adhaesivum
tacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaacactgacgctgaggcgcgaaagcgtggggagcaaacagg

SEQ ID NO: 306 - DNA, 253 bp, Unknown
  Kingdom: Bacteria, Phylum: Bacteroidetes, Class: Saprospirae, Order: Saprospirales, Family: Chitinophagaceae, Genus: Sediminibacterium
tacggagggtgcaagcgttatccggattcactgggtttaaagggtgcgtaggcgggtatgtaagtcagtggtgaaataccggagcttaacttcggaactgccattgatactatatatcttgaatattgtggaggtaagcggaatatgtcatgtagcggtgaaatgcttagagatgacatagaacaccgattgcgaaggcagcttgctacgcaaatattgacgctgaggcacgaaagcgtggggatcaaacagg

SEQ ID NO: 307 - DNA, 253 bp, Asticcacaulis biprosthecium
tacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacagg

SEQ ID NO: 308 - DNA, 253 bp, Unknown
  Kingdom: Bacteria, Phylum: Bacteroidetes, Class: Flavobacteriia, Order: Flavobacteriales, Family: Weeksellaceae, Genus: Chryseobacterium
tacggagggtgcaagcgttatccggatttattgggtttaaagggtccgtaggcggatccgtaagtcagtggtgaaatctcatagcttaactatgaaactgccattgatactgcgggtcttgagtgagattgaggtagctggaataagtagtgtagcggtgaaatgcatagatattacttagaacaccaattgcgaaggcaggttaccaagtcttaactgacgctgatggacgaaagcgtggggagcgaacagg

SEQ ID NO: 309 - DNA, 253 bp, Unknown
  Kingdom: Bacteria, Phylum: Proteobacteria, Class: Alphaproteobacteria, Order: Rhizobiales, Family: Rhizobiaceae, Genus: Rhizobium
tacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 310 - DNA, 253 bp, Unknown
  Kingdom: Bacteria, Phylum: Actinobacteria, Class: Actinobacteria, Order: Actinomycetales, Family: Micrococcaceae
tacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacagg

SEQ ID NO: 311 - DNA, 253 bp, Unknown
  Kingdom: Bacteria, Phylum: Bacteroidetes, Class: Flavobacteriia, Order: Flavobacteriales, Family: Weeksellaceae, Genus: Chryseobacterium
tacggagggtgcaagcgttatccggatttattgggtttaaagggtccgtaggcggatctgtaagtcagtggtgaaatctttcggcttaaccggaaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 312 - DNA, 253 bp, Unknown
  Kingdom: Bacteria, Phylum: Firmicutes, Class: Bacilli, Order: Bacillales, Family: Staphylococcaceae, Genus: Staphylococcus
tacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 313 - DNA, 253 bp, Unknown
  Kingdom: Bacteria, Phylum: Proteobacteria, Class: Betaproteobacteria, Order: Burkholderiales, Family: Oxalobacteraceae, Genus: Ralstonia
tacgtagggtccaagcgttaatcggaattactgggcgtaaagcgtgcgcaggcggttgtgcaagaccgatgtgaaatccccgggcttaacctgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 314 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
gacggggggtgcaagcgttaatcggaattactgggcgtaaagcgcgcgtaggtggtttgttaagttggatgtgaaatccccgggctcaacctgggaactgcattcaaaacagactgactagagtatggtagagggcggtggaatttcctgtgtagcggtgaaatgcgtagatataggaaggaacaccagtggcgaaggcgaccacctggactaatactgacactgaggtgcgaaagcgtggggagcaaacagg

SEQ ID NO: 315 - DNA, 253 bp, Unknown
  Kingdom: Bacteria, Phylum: Proteobacteria, Class: Alphaproteobacteria, Order: Rhizobiales, Family: Methylobacteriaceae, Genus: Methylobacterium
tacgaagggggctagcgttgctcggaatcactgggcgtaaagggcgcgtaggcggccttgtaagttgggggtgaaagcccgtggctcaaccacggaattgccttcgatactgcttggcttgagtgtggtagaggttggtggaactgcgagtgtagaggtgaaattcgtagatattcgcaagaacaccggtggcgaaggcggccaactggaccatcactgacgctgaggcgcgaaagcgtggggagcaaacagg

SEQ ID NO: 316 - DNA, 253 bp, Unknown
  Kingdom: Bacteria, Phylum: Proteobacteria, Class: Gammaproteobacteria, Order: Alteromonadales, Family: Alteromonadaceae, Genus: Cellvibrio
tacggagggtgcaagcgttaatcggaattactgggcgtaaagcgcacgtaggtggtttgttaagctagctgtgaaatccccgggctcaacctgggcactgcagttagaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 317 - DNA, 253 bp, Unknown
  Kingdom: Bacteria, Phylum: Firmicutes, Class: Bacilli, Order: Bacillales, Family: Bacillaceae
tacgtaggtggcaagcgttatccggaattattgggcgtaaagcgctcgcaggcggtcttttaagtctgatgtgaaagcccacggctcaaccgtggagggtcattggaaactgggagacttgagtgcagaagaggagagtggaattccacgtgcagcggtgaaatgcgtagagatgtggaggaacaccagtggcgaaggcgactctctggtctgtaactgacgctgaggagcgaaagcgtggggagcgaacagg

SEQ ID NO: 318 - DNA, 253 bp, Unknown
  Kingdom: Bacteria, Phylum: Firmicutes, Class: Bacilli, Order: Bacillales, Family: Planococcaceae, Genus: Solibacillus
tacgtaggtggcaagcgttgtccggaattattgggcgtaaagcgcgcgcaggtggttccttaagtctgatgtgaaagcccccggctcaaccggggagggtcattggaaactggggaacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacagg

SEQ ID NO: 319 - DNA, 253 bp, Unknown
  Kingdom: Bacteria, Phylum: Proteobacteria, Class: Gammaproteobacteria, Order: Legionellales, Family: Coxiellaceae, Genus: Aquicella
tacagagggtgcgagcgttgatcggaattactgggcgtaaagggcgcgtaggcggttacatgagtgtgctgtgaaagccccgggcttaacctgggaagtgcagtgcaaacgatgtaactggagtagatgagagggtggtggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 320 - DNA, 253 bp, Unknown
  Kingdom: Bacteria, Phylum: Proteobacteria, Class: Alphaproteobacteria, Order: Rhizobiales, Family: Methylocystaceae
tacgaagggggctagcgttgttcggaatcactgggcgtaaagggtgcgtaggcgggatcttaagtcaggggtgaaatcccgaggctcaacctcggaactgcctttgatactggggtccttgagtccggaagaggtgagtggaactgcgagtgtagaggtgaaattcgtagatattcgcaagaacaccggtggcgaaggcggctcactggtccggaactgacgctgaggcacgacagcgtggggagcaaacagg

SEQ ID NO: 321 - DNA, 253 bp, Unknown
  Kingdom: Bacteria, Phylum: Actinobacteria, Class: Actinobacteria, Order: Actinomycetales, Family: Microbacteriaceae, Genus: Yonghaparkia
tacgtagggtgcaagcgttgtccggaattattgggcgtaaagagctcgtaggcggtttgtcgcgtctgctgtgaaaacgcgaggctcaacctcgcgcctgcagtgggtacgggcagactagagtgtggtaggggagattggaattcctggtgtagcggtggaatgcgcagatatcaggaggaacaccgatggcgaaggcagatctctgggctattactgacgctgaggagcgaaagcgtggggagcgaacagg

SEQ ID NO: 322 - DNA, 253 bp, Unknown
  Kingdom: Bacteria, Phylum: Proteobacteria, Class: Gammaproteobacteria, Order: Pseudomonadales, Family: Pseudomonadaceae
tacgaagggtgcaagcgttaatcggaattactgggcgtaaagcgcgcgtaggtggttcagcaagttggatgtgaaagccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 323 - DNA, 253 bp, Acinetobacter lwoffii
tacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacagg

SEQ ID NO: 324 - DNA, 253 bp, Streptomyces mirabilis
tacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 325 - DNA, 253 bp, Unknown
  Kingdom: Bacteria, Phylum: Firmicutes, Class: Bacilli, Order: Lactobacillales, Family: Leuconostocaceae
tacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacagg

SEQ ID NO: 326 - DNA, 253 bp, Unknown
  Kingdom: Bacteria, Phylum: Actinobacteria, Class: Actinobacteria, Order: Actinomycetales, Family: Micromonosporaceae, Genus: Actinoplanes
gacgtagggcgcgagcgttgtccggatttattgggcgtaaagagctcgtaggcggcttgtcgcgtcgactgtgaaatctcagggctcaactctgacattgcagtcgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacagg

SEQ ID NO: 327 - DNA, 253 bp, Unknown
  Kingdom: Bacteria, Phylum: Bacteroidetes, Class: Sphingobacteriia, Order: Sphingobacteriales, Family: Sphingobacteriaceae, Genus: Pedobacter
tacggagggtgcaagcgttatccggatttattgggtttaaagggtgcgtaggcggcccgttaagtcaggggtgaaagacggtagctcaactatcgcagtgcctttgatactgacgggcttgaatgaactagaggtaggcggaatgagacaagtagcggtgaaatgcatagatatgtctcagaacaccgattgcgaaggcagcttactatggtttaattgacgctgaggcacgaaagcgtggggatcaaacagg

SEQ ID NO: 328 - DNA, 252 bp, Unknown
  Kingdom: Bacteria, Phylum: Tenericutes, Class: Mollicutes, Order: Mycoplasmatales, Family: Mycoplasmataceae, Genus: Mycoplasma
aacataggtcacgagcattatccggatttattgggcgtaaaggaagcgtaggcggggaggttgatccattgttaaaagcatttgcttaacaaatgtgtgcattggagatcgcctccctagagttaatcagggggtactggaattcaatgtgtagcggtggaatgcgtagatatattgaggaacaccagaggctaaggcgagtgcctaggatataactgacgctgaggcttgaaagcgtggggagcaaatggg

SEQ ID NO: 329 - DNA, 253 bp, Unknown
  Kingdom: Bacteria, Phylum: Actinobacteria, Class: Actinobacteria, Order: Actinomycetales, Family: Microbacteriaceae
tacgtagggtgcaagcgttgtccggaattattgggcgtaaagagctcgtaggcggtttgtcgcgtctgctgtgaaaacccggggctcaacctcgggcctgcagtgagtacgggcagactagagtgcggtaggggagaatggaattcctggtgtagcggtggaatgcgcagatatcaggaggaacaccgatggcgaaggcagttctctgggccgtaactgacgccgaggagcgaaagcgtggggagcaaacagg

SEQ ID NO: 330 - DNA, 253 bp, Unknown
  Kingdom: Bacteria, Phylum: Bacteroidetes, Class: Sphingobacteriia, Order: Sphingobacteriales, Family: Sphingobacteriaceae
tacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 331 - DNA, 253 bp, Unknown
  Kingdom: Bacteria, Phylum: Proteobacteria, Class: Betaproteobacteria, Order: Burkholderiales, Family: Oxalobacteraceae
gacggggggggcaagcgttaatcggaattactgggcgtaaagcgtgcgcaggcggttttgtaagtctgacgtgaaatccccgggctcaacctgggaattgcgttggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 332 - DNA, 253 bp, Unknown
  Kingdom: Bacteria, Phylum: Actinobacteria, Class: Actinobacteria, Order: Actinomycetales, Family: Streptomycetaceae
tacgtagggcgcgagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 333 - DNA, 253 bp, Unknown
  Kingdom: Bacteria, Phylum: Proteobacteria, Class: Betaproteobacteria, Order: Burkholderiales, Family: Oxalobacteraceae, Genus: Herbaspirillum
tacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 334 - DNA, 253 bp, Unknown
  Kingdom: Bacteria, Phylum: Proteobacteria, Class: Betaproteobacteria, Order: Burkholderiales, Family: Comamonadaceae
tacgtagggtgcaagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 335 - DNA, 253 bp, Unknown
  Kingdom: Bacteria, Phylum: Acidobacteria, Class: Acidobacteriia, Order: Acidobacteriales, Family: Acidobacteriaceae
tacgaggggggcaagcgttgttcggaattattgggcgtaaagggtgcgtaggcggttcggtaagtcttatgtgaaatcttcgggctcaactcgaagtctgcatgagaaactgccgggcttgagtgtgggagaggtgagtggaatttccggtgtagcggtgaaatgcgtagatatcggaaggaacacctgtggcgaaagcggctcactggaccataactgacgctgatgcacgaaagctaggggagcaaacagg

SEQ ID NO: 336 - DNA, 253 bp, Unknown
  Kingdom: Bacteria, Phylum: Proteobacteria, Class: Gammaproteobacteria, Order: Xanthomonadales, Family: Xanthomonadaceae, Genus: Arenimonas
tacgaagggtgcaagcgttactcggaattactgggcgtaaagcgtgcgtaggtggttcgttaagtctgccgtgaaagccccgggctcaacctgggaatggcggtggatactggcggactagagtgcggtagagggtggtggaattcccggtgtagcagtgaaatgcgtagagatcgggaggaacatctgtggcgaaggcggccacctggaccagcactgacactgaggcacgaaagcgtggggagcaaacagg

SEQ ID NO: 337 - DNA, 253 bp, Arthrobacter psychrolactophilus
tacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 338 - DNA, 253 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
tacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 339 - DNA, 253 bp, Unknown
  Kingdom: Bacteria, Phylum: Proteobacteria, Class: Alphaproteobacteria, Order: Sphingomonadales, Family: Erythrobacteraceae
tacggagggggctagcgttgttcggaaatactgggcgtaaagcgaacgtaggcggcttggcaagtcaggggtgaaatcccagtgctcaacactggaactgcctttgaaactgccaggcttgaatcctggagaggcgagtggaattccgagtgtagaggtgaaattcgtagatattcggaagaacaccagtggcgaaggcgactcgctggacaggtattgacgctgaggttcgaaagcgtggggagcaaacagg

SEQ ID NO: 340 - DNA, 252 bp, Unknown
  Kingdom: Bacteria, Phylum: Firmicutes, Class: Clostridia, Order: Clostridiales, Family: Tissierellaceae, Genus: Peptoniphilus
tacgtagggggctagcgttgtccggaatcactgggcgtaaagggttcgcaggcggaaatgcaagtcagatgtaaaaggcagtagcttaactactgtaagcatttgaaactgcatatcttgagaagagtagaggtaagtggaatttttagtgtagcggtgaaatgcgtagatattaaaaagaataccggtggcgaaggcgacttactgggctcattctgacgctgaggaacgaaagcgtgggtagcaaacagg

SEQ ID NO: 341 - DNA, 253 bp, Unknown
  Kingdom: Bacteria, Phylum: Bacteroidetes, Class: Sphingobacteriia, Order: Sphingobacteriales, Family: Sphingobacteriaceae
tacggaggatccaagcgttatccggatttattgggtttaaagggtgcgtaggtggcctattaagtcaggggtgaaagacggtagcttaactatcgcagtgcctttgatactgatgggcttgaatacagttgaagtaggcggaatgtgacaagtagcggtgaaatgcatagatatgtcacagaacaccgattgcgaaggcagcttactaaagtgtgattgacactgaggcacgaaagcgtggggatcaaacagg

SEQ ID NO: 342 - DNA, 253 bp, Unknown
  Kingdom: Bacteria, Phylum: Bacteroidetes, Class: Sphingobacteriia, Order: Sphingobacteriales, Family: Sphingobacteriaceae, Genus: Pedobacter
tacggaggatccaagcgttatccggatttattgggtttaaagggtgcgtaggcggcttattaagtcaggggtgaaagacggtggctcaaccatcgcagtgcctttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 343 - DNA, 253 bp, Enterobacter hormaechei
tacggagggtgcaagcgttaatcggaattactgggcgtaaagcgcacgcaggcgatctgtcgagtgggatgtgaaatccccgggctcaacctggggactgcgttcgaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 344 - DNA, 253 bp, Rhodococcus fascians
tacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacagg

SEQ ID NO: 345 - DNA, 253 bp, Unknown
  Kingdom: Bacteria, Phylum: Bacteroidetes, Class: Flavobacteriia, Order: Flavobacteriales, Family: Weeksellaceae, Genus: Chryseobacterium
tacggagggtgcaagcgttatccggatttattgggtttaaagggtccgtaggcggatctgtaagtcagtggtgaaatctcatagcttaactatgaaactgccattgatactgcaggtcttgagtaaagtagaagtggctggaataagtagtgtagcggtgaaatgcatagatattacttagaacaccaattgcgaaggcaggtcactatgttttaactgacgctgatggacgaaagcgtggggagcgaacagg

SEQ ID NO: 346 - DNA, 253 bp, Unknown
  Kingdom: Bacteria, Phylum: Proteobacteria, Class: Betaproteobacteria, Order: Burkholderiales, Family: Oxalobacteraceae, Genus: Janthinobacterium
tacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 347 - DNA, 252 bp, Unknown
  Kingdom: Bacteria, Phylum: Firmicutes, Class: Bacilli, Order: Bacillales, Family: Paenibacillaceae, Genus: Paenibacillus
tacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 348 - DNA, 253 bp, Unknown
  Kingdom: Bacteria, Phylum: Actinobacteria, Class: Actinobacteria, Order: Actinomycetales, Family: Actinosynnemataceae
tacgtagggtgcgagcgttgtccggaattattgggcgtaaagagctcgtaggcggtttgtcgcgtcggccgtgaaaacttggggcttaaccccgagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 349 - DNA, 253 bp, Unknown
  Kingdom: Bacteria, Phylum: Actinobacteria, Class: Actinobacteria, Order: Actinomycetales, Family: Nocardioidaceae, Genus: Aeromicrobium
tacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacagg

SEQ ID NO: 350 - DNA, 253 bp, Unknown
  Kingdom: Bacteria, Phylum: Actinobacteria, Class: Actinobacteria, Order: Actinomycetales, Family: Microbacteriaceae, Genus: Rathayibacter
tacgtagggtgcgagcgttgtccggaattattgggcgtaaagagctcgtaggcggtctgtcgcgtctgctgtgaaaacccgaggctcaacctcgggcctgcagtgggtacgggcagactagagtgcggtaggggagaatggaactcctggtgtagcggtggaatgcgcagatatcaggaagaacaccgatggcgaaggcagttctctgggccgtaactgacgctgaggagcgaaagcgtggggagcgaacagg

SEQ ID NO: 351 - DNA, 253 bp, Unknown
  Kingdom: Bacteria, Phylum: Actinobacteria, Class: Actinobacteria, Order: Actinomycetales, Family: Microbacteriaceae, Genus: Salinibacterium
tacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 352 - DNA, 253 bp, Unknown
  Kingdom: Bacteria, Phylum: Proteobacteria, Class: Betaproteobacteria, Order: Burkholderiales, Family: Comamonadaceae
tacgtagggtgcaagcgttaatcggaattactgggcgtaaagcgtgcgcaggcggctttgtaagacagatgtgaaatccccgggctcaacctgggaactgcatttgtgactgcaaggctagagtacggtagaggggagtggaattccgcgtgtagcagtgaaatgcgtagatatgcggaggaacaccgatggcgaaggcagctccctggacctgtactgacgctcatgcacgaaagcgtggggagcaaacagg

SEQ ID NO: 353 - DNA, 253 bp, Unknown
  Kingdom: Bacteria, Phylum: Actinobacteria, Class: Actinobacteria, Order: Actinomycetales, Family: Nocardioidaceae, Genus: Nocardioides
tacgtagggtccgagcgttgtccggaattattgggcgtaaagggctcgtaggcggtctgtcgcgtcgggagtgaaaaccaggtgcttaacacctggcctgcttccgatacgggcagactagaggtactcaggggagaatggaattcctggtgtagcggtgaaatgcgcagatatcaggaggaacaccggtggcgaaggcggttctctgggagtatcctgacgctgaggagcgaaagtgtggggagcgaacagg

SEQ ID NO: 354 - DNA, 253 bp, Unknown
  Kingdom: Bacteria, Phylum: Proteobacteria, Class: Betaproteobacteria, Order: Burkholderiales, Family: Comamonadaceae, Genus: Polaromonas
tacgtagggtgcaagcgttaatcggaattactgggcgtaaagcgtgcgcaggcggttatgtaagacagttgtgaaatccccgggctcaacctgggaattgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 355 - DNA, 253 bp, Lentzea albidocapillata
tacgtagggcgcaagcgttatccggaattattgggcgtaaagagctcgtaggcggtttgtcgcgtcggccgtgaaaacttggggcttaaccccaagcttgcggtcgatacgggcagacttgagttcggcaggggagactggaattcctggtgtagcggtgaaatgcgcagatatcaggaggaacaccggtggcgaaggcgggtctctgggccgacactgacgctgaggagcgaaagcgtggggatcaaacagg

SEQ ID NO: 356 - DNA, 253 bp, Unknown
  Kingdom: Bacteria, Phylum: Proteobacteria, Class: Betaproteobacteria, Order: Burkholderiales, Family: Comamonadaceae
tacgtagggtgcgagcgttaatcggaattactgggcgtaaagcgtgcgcaggcggtgatgtaagacaggtgtgaaatccccgagctcaacctgggaactgcacttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 357 - DNA, 253 bp, Unknown
  Kingdom: Bacteria, Phylum: Proteobacteria, Class: Alphaproteobacteria, Order: Caulobacterales, Family: Caulobacteraceae, Genus: Caulobacter
tacgaagggggctagcgttgctcggaattactgggcgtaaagggagcgtaggcggactgttaagttagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 358 - DNA, 253 bp, Unknown
  Kingdom: Bacteria, Phylum: Bacteroidetes, Class: Flavobacteriia, Order: Flavobacteriales, Family: Flavobacteriaceae, Genus: Flavobacterium
tacggaggatccaagcgttatccggaatcattgggtttaaagggtccgtaggcggccttataagtcagtggtgaaatcccgcagctcaactgtggaatggccattgatactgtagggcttgaattatagtgaagtaactagaatatgtagtgtagcggtgaaatgcttagatattacatggaatacccattgcgaaggcaggttactaactatggattgacgctgatggacgaaagcgtggggagcgaacagg

SEQ ID NO: 359 - DNA, 253 bp, Unknown
  Kingdom: Bacteria, Phylum: Proteobacteria, Class: Gammaproteobacteria, Order: Enterobacteriales, Family: Enterobacteriaceae
aacggggggggcaagtgttcttcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 360 - DNA, 253 bp, Unknown
  Kingdom: Bacteria, Phylum: Proteobacteria, Class: Gammaproteobacteria, Order: Xanthomonadales, Family: Xanthomonadaceae, Genus: Stenotrophomonas
tacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacgtccatggcgaaggcatctacctggaccaacactgacactgaggcacgaaagcgtggggagcaaacggg

SEQ ID NO: 361 - DNA, 253 bp, Caldicellulosiruptor saccharolyticus
tacgtaggtggcgagcgttgtccggaattactgggcgtaaagggtgcgtaggcggcctggtaagttgagcgtgaaatttttgggctcaacccaaaaggagcgctcaatactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacagg

SEQ ID NO: 362 - DNA, 253 bp, Unknown
  Kingdom: Bacteria, Phylum: Proteobacteria, Class: Gammaproteobacteria, Order: Xanthomonadales, Family: Xanthomonadaceae, Genus: Rhodanobacter
tacgaagggtgcaagcgttaatcggaattactgggcgtaaagggtgcgtaggcggttatttaagtctgctgtgaaatccccgggctcaacctgggaatggcagtggatactggatagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 363 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggagctagcgttattcggaattacagggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatatccggaggaacaccagtggcgaaggcggctcactggactggtatcgacgctgaggtgcgaaagcgtggggagcaaacagg

SEQ ID NO: 364 - DNA, 253 bp, Lacibacter cauensis
tacggagggtgcaagcgttatccggattcactgggtttaaagggagcgtaggtggacttttaagtcagtggtgaaatctctgggcttaacccggaaactgccattgatactattagtcttgaattctctggaggtaagcggaatatgtcatgtagcggtgaaatgcttagatatgacatagaacacccattgcgaaggcagcttactacggagacattgacactgaggctcgaaagcgtggggatcaaacagg

SEQ ID NO: 365 - DNA, 253 bp, Unknown
  Kingdom: Bacteria, Phylum: Actinobacteria, Class: Actinobacteria, Order: Actinomycetales, Family: Nocardioidaceae, Genus: Kribbella
tacgtagggtccgagcgttgtccggaattattgggcgtaaagggctcgtaggcggttcgtcacgtcgggagtgaaaactcggggcttaaccccgagcctgcttccgatacgggcagactagaggtaggcaggggagagcggaactcctggtgtagcggtggaatgcgcagatatcaggaagaacaccggtggcgaaggcggctctctgggccttacctgacgctgaggagcgaaagcgtgggtagcgaacagg

SEQ ID NO: 366 - DNA, 253 bp, Unknown
  Kingdom: Bacteria, Phylum: Bacteroidetes, Class: Cytophagia, Order: Cytophagales, Family: Cytophagaceae, Genus: Hymenobacter
tacggagggtgcgagcgttgtccggatttattgggtttaaagggtgcgtaggcggctttttaagtctggggtgaaagcccgctgctcaacagcggaactgccctggatactggagagcttgagtacagacgaggttggcggaatggactgagtagcggtgaaatgcatagatacagtccagaaccccgattgcgaaggcagctgactaggctgttactgacgctgaggcacgaaagcgtggggagcgaacagg

SEQ ID NO: 367 - DNA, 253 bp, Unknown
  Kingdom: Bacteria, Phylum: Proteobacteria, Class: Deltaproteobacteria, Order: Syntrophobacterales, Family: Syntrophobacteraceae
gacggagggtgcaagcgttgttcggattgactgggcgtaaagggcgtgtaggcggttgcccaagtccgatgtgaaagcccgaggcctaccctcggaagtgcatcggaaactaggcagctggagcgcgatagaggagggtagaattcctggagtagcggtgaaatgcgtagatatcaggaggaataccggcggcgaaggcggccctctggatcgttgctgacgctgagacgcgaaagcgtggggagcaaacagg

SEQ ID NO: 368 - DNA, 253 bp, Unknown
  Kingdom: Bacteria, Phylum: Firmicutes, Class: Clostridia, Order: Clostridiales, Family: Clostridiaceae, Genus: Caloramator
tacgtaggtggcaagcgttgtccggaattactgggcgtaaagggtgcgtaggcggtcctttaagtgggatgtgaaatccctgggcttaacccaggaactgcattccaaactggaggactagagtgcaggagaggaaagcggtattcccagtgtagcggtgaaatgcgtagagattgggaggaacaccagtagcgaaggcggctttctggaatgtaactgacgctgaggcacgaaagcgtggggagcaaacagg

SEQ ID NO: 369 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacagagggtgcaagcgttaatcggaattactgggcgtaaagcgcgcgtaggtggtttgttaagttggatgtgaaatccccgggttcaacctgggaactgcattcaaaactgacaagctagagtatggtagagggtggtggaatttcctgtgtagcggtgaaatgcgtaaatacaggaaggaacaccagtggcgaaggcgaccacctggactgatactgacactgaggtgcgaaagcgtggggagcaaacagg

SEQ ID NO: 370 - DNA, 253 bp, Sphingomonas wittichii
tacggagggggctagcgttgttcggaattactgggcgtaaagcgtacgtaggcggttttgtaagttagaggtgaaagcccggagctcaacttcggaattgcctttaagactgcatcacttgaacgtcggagaggtgagtggaattccgagtgtagaggtgaaattcgtagatattcggaagaacaccagtggcgaaggcggctcactggacgactgttgacgctgaggtacgaaagcgtggggagcaaacagg

SEQ ID NO: 371 - DNA, 253 bp, Unknown
  Kingdom: Bacteria, Phylum: Actinobacteria, Class: Actinobacteria, Order: Actinomycetales, Family: Microbacteriaceae, Genus: Salinibacterium
tacgtagggtgcgagcgttatccggaattattgggcgtaaagagctcgtaggcggtttgtcacgtctgctgtgaaaactggaggctcaaccttcagcctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagcgtggggagcgaacagg

SEQ ID NO: 372 - DNA, 253 bp, Unknown
  Kingdom: Bacteria, Phylum: Actinobacteria, Class: Actinobacteria, Order: Actinomycetales, Family: Promicromonosporaceae, Genus: Promicromonospora
tacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacagg

SEQ ID NO: 373 - DNA, 253 bp, Lysinibacillus massiliensis
tacgtagggtgcgagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacagg

SEQ ID NO: 374 - DNA, 253 bp, Unknown
  Kingdom: Bacteria, Phylum: Proteobacteria, Class: Alphaproteobacteria, Order: Rhizobiales, Family: Hyphomicrobiaceae, Genus: Devosia
tacgaagggggctagcgttgttcggatttactgggcgtaaagcgcacgtaggcggtttgttaagtcaggggtgaaatcccagagctcaactctggaactgcctttgatactggcaagctcgagtccggaagaggtaagtggaactcctagtgtagaggtggaattcgtagatattaggaagaacaccagtggcgaaggcggcttactggtccggaactgacgctgaggtgcgaaagcgtggggagcaaacagg

SEQ ID NO: 375 - DNA, 253 bp, Unknown
  Kingdom: Bacteria, Phylum: Proteobacteria, Class: Alphaproteobacteria, Order: Rhizobiales, Family: Aurantimonadaceae
tacgaagggggctagcgttgttcggaattactgggcgtaaagcgcacgtaggcggacatttaagtcaggggtgaaatcccggggctcaaccccggaactgcctttgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacagg

SEQ ID NO: 376 - DNA, 253 bp, Unknown
  Kingdom: Bacteria, Phylum: Firmicutes, Class: Bacilli, Order: Bacillales, Family:
tacgtaggtggcaagcgttgtccggaattattgggcgtaaagcgcgcgcaggtggtctcttaagtctgatgtgaaagcccccggctcaaccggggagggtcattggaaactgggagacttgagtgcaggagagaagagtggaattccacgtgtagcggtgaaatgcgtagagatgtggaggaacaccagtggcgaaggcgactctttggcctgtaactgacactgaggcgcgaaagcgtggggagcaaacagg

SEQ ID NO: 377 - DNA, 253 bp, Unknown
  Kingdom: Bacteria, Phylum: Proteobacteria, Class: Gammaproteobacteria, Order: Xanthomonadales, Family: Xanthomonadaceae, Genus: Stenotrophomonas
tacgaagggtgcaagcgttactcggaattactgggcgtaaagcgtgcgtaggtggttatttaagtccgttgtgaaagccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacagg

SEQ ID NO: 378 - DNA, 253 bp, Unknown
  Kingdom: Bacteria, Phylum: Bacteroidetes, Class: Sphingobacteriia, Order: Sphingobacteriales, Family: Sphingobacteriaceae, Genus: Pedobacter
tacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacagg

SEQ ID NO: 379 - DNA, 253 bp, Unknown
  Kingdom: Bacteria, Phylum: Actinobacteria, Class: Actinobacteria, Order: Actinomycetales, Family: Nocardioidaceae
tacgtagggtgcgagcgttgtccggaattattgggcgtaaagggctcgtaggcggtttgtcgcgtcgggagtgaaaacacacagcttaactgtgtgcttgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 380 - DNA, 253 bp, Thermoanaerobacterium saccharolyticum
tacgtagggggcgagcgttgtccggaattactgggcgtaaagagcacgtaggcggctatataagtcaggtgtgaaaaacctgggcttaaccgagggtatgcatctgaaactatatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacagg

SEQ ID NO: 381 - DNA, 253 bp, Unknown
  Kingdom: Bacteria, Phylum: Actinobacteria, Class: Actinobacteria, Order: Actinomycetales, Family: Kineosporiaceae, Genus: Kineococcus
tacgtagggtgcaagcgttgtccggaattattgggcgtaaagagctcgtaggcggtgtgtcgcgtctgctgtgaaaactcagggctcaactctgagcttgcagtgggtacgggcacactagagtgctgtaggggagactggaattcctggtgtagcggtgaaatgcgcagatatcaggaggaacaccggtggcgaaggcgggtctctgggcagttactgacgctgaggagcgaaagcatggggagcgaacagg

SEQ ID NO: 382 - DNA, 253 bp, Unknown
  Kingdom: Bacteria, Phylum: Proteobacteria, Class: Betaproteobacteria, Order: Burkholderiales, Family: Comamonadaceae
tacgtagggtgcgagcgttaatcggaattactgggcgtaaagcgtgcgcaggcggctttgcaagacagaggtgaaatccccgggctcaacctgggaactgcctttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 383 - DNA, 253 bp, Unknown
  Kingdom: Bacteria, Phylum: Bacteroidetes, Class: Cytophagia, Order: Cytophagales, Family: Cytophagaceae, Genus: Dyadobacter
tacggagggtgcgagcgttgtccggatttattgggtttaaagggtgcgtaggtggctgtttaagtcagtggtgaaatacggttgctcaacaatcgaggtgccattgatactgaatagcttgaaataattggaggctgccggaatggatggtgtagcggtgaaatgcatagatatcatccagaacaccgattgcgaaggcaggtggctacgattggtttgacactgaggcacgaaagcatggggagcaaacagg

SEQ ID NO: 384 - DNA, 253 bp, Peredibacter starrii
tacgaagggtccaagcgttgttcggaatcattgggcgtaaagcgcgcgcaggcggatcagcaagtcagatgtgaaatctcgaagctcaacttcgaaactgcgtctgaaactgctagtctagagtgtcggagggggtaggggaatttcacgtgtaggggtaaaatccgtagagatgtgaaggaacaccggaggcgaaggcgcctacctggacgactactgacgctgaggcgcgaaagcgtggggagcaaacagg

SEQ ID NO: 385 - DNA, 254 bp, Unknown
  Kingdom: Bacteria, Phylum: Proteobacteria, Class: Deltaproteobacteria, Order: Myxococcales, Family: Cystobacterineae
gacagagggtgcaagcgttgttcggaattattgggcgtaaagggcgcgtaggcggcccatcaagtcggatgtgaaagcccagggctcaaccttggaagtgcatccgaaactgatgagctagagttcacggagagggtggtggaattcccagtgtagaggtgaaattcgtagatattgggaggaacaccggtggcgaaggcgaccacctggacggaaactgacgctgaggcgcgaaagcgtgggtagcaaacagg

SEQ ID NO: 386 - DNA, 253 bp, Unknown
  Kingdom: Bacteria, Phylum: Bacteroidetes, Class: Cytophagia, Order: Cytophagales, Family: Cytophagaceae, Genus: Hymenobacter
tacggagggtgcgagcgttgtccggatttattgggtttaaagggtgcgtaggcggccgactaagtctggggtgaaagcccgctgctcaacagcggaactgccctggatactggttggcttgagtacagacgaggttggcggaatggacggagtagcggtgaaatgcatagataccgtccagaaccccgattgcgaaggcagctgactaggctgttactgacgctgaggcacgaaagcgtggggagcgaacagg

SEQ ID NO: 387 - DNA, 253 bp, Janthinobacterium lividum
tacgtagggtgcaagcgttaatcggaattactgggcgtaaagcgtgcgcaggcggttttgtaagtctgatgtgaaatccccgggctcaacctgggaattgcattggagactgcaaggctagaatctggcagaggggggtagaactccacgtgtagcagtgaaatgcgtagatatgtggaggaacaccgatggcgaaggcagccccctgggtcaagattgacgctcatgcacgaaagcgtggggagcaaacagg

SEQ ID NO: 388 - DNA, 253 bp, Unknown
  Kingdom: Bacteria, Phylum: Proteobacteria, Class: Alphaproteobacteria, Order: Rhodospirillales, Family: Acetobacteraceae
tacgaagggggctagcgttactcggaattactgggcgtaaagggcgcgtaggcggcgctccaagttaggcgtgaaagtcctgggctcaacctgggaactgcgcttaagactggagtgcttgaggatggaagagggtcgtggaattcccagtgtagaggtgaaattcgtagatattgggaagaacaccggtggcgaaggcggcgacctggtccattactgacgctgaggcgcgacagcgtggggagcaaacagg

SEQ ID NO: 389 - DNA, 253 bp, Flavobacterium succinicans
tacggaggatccaagcgttatccggaatcattgggtttaaagggtccgtaggcggtttggtaagtcagtggtgaaagcccatcgctcaacggtggaacggccattgatactgccagacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 390 - DNA, 253 bp, Unknown
  Kingdom: Bacteria, Phylum: Bacteroidetes, Class: Flavobacteriia, Order: Flavobacteriales, Family: Flavobacteriaceae, Genus: Flavobacterium
tacggaggatccaagcgttatccggaatcattgggtttaaagggtccgtaggcggttttataagtcagtggtgaaatccggcagctcaactgtcgaactgccattgatactgtaggacttgaattattgtgaagtaactagaatatgtagtgtagcggtgaaatgcttagatattacatggaataccgattgcgaaggcaggttactaacaatatattgacgctgatggacgaaagcgtggggagcgaacagg

SEQ ID NO: 391 - DNA, 253 bp, Unknown
  Kingdom: Bacteria, Phylum: Proteobacteria, Class: Alphaproteobacteria, Order: Rhizobiales, Family: Hyphomicrobiaceae, Genus: Devosia
tacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 392 - DNA, 253 bp, Unknown
  Kingdom: Bacteria, Phylum: Proteobacteria, Class: Gammaproteobacteria, Order: Enterobacteriales, Family: Enterobacteriaceae
tacggagggtgcaagcgttaatcgggattactgggcgtaaagcgcacgcaggcggtctgtcaagtcggatgtgaaatccccgggcttaacctgggaactgcattcgaaaccggcaggctagagtcttgtaggggggggtagaattccaggtgtagcggtgaaatgcgtagagatctggaggaataccggtggcgaaggcggccccctggacaaagactgacgctcaggagcgaaagcgtggggagcaaacagg

SEQ ID NO: 393 - DNA, 253 bp, Unknown
  Kingdom: Bacteria, Phylum: Firmicutes, Class: Clostridia, Order: Thermoanaerobacterales, Family: Carboxydocellaceae, Genus: Carboxydocella
aacgtagggggcgagcgttatccggaattactgggcgtaaagcgcgtgtaggcgggctgttaagtcggttgtgaaaatccggggctcaactccggacatgcagccgatactgacagtcttgagggcaggagagggaagcggaattcccggtgtagcggtgaaatgcgtagatatcgggaggaacaccagtggcgaaggcggctttctggactgtacctgacgctgagacgcgaaagcgtggggagcaaacagg

SEQ ID NO: 394 - DNA, 253 bp, Unknown
  Kingdom: Bacteria, Phylum: Actinobacteria, Class: Actinobacteria, Order: Actinomycetales, Family: Streptomycetaceae, Genus: Streptomyces
tacgtagggtgcgagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 395 - DNA, 253 bp, Unknown
  Kingdom: Bacteria, Phylum: Proteobacteria, Class: Alphaproteobacteria, Order: Caulobacterales, Family: Caulobacteraceae, Genus: Caulobacter
tacgaagggggctagcgttgctcggaattactgggcgtaaagggagcgtaggcggatagtttagtcagaggtgaaagcccagggctcaaccttggaattgcctttgatactggctatcttgagtatggaagaggtatgtggaactccgagtgtagaggtgaaattcgtagatattcggaagaacaccagtggcgaaggcgacatactggtccattactgacgctgaggctcgaaagcgtggggagcaaacagg

SEQ ID NO: 396 - DNA, 253 bp, Unknown
  Kingdom: Bacteria, Phylum: Proteobacteria, Class: Alphaproteobacteria, Order: Sphingomonadales, Family: Sphingomonadaceae
tacggagggagctagcgttgttcggaattactgggcgtaaagcgcgcgtaggcggtccattaagtcagaggtgaaagcccggggctcaaccccggaactgcctttgaaactagcggactagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 397 - DNA, 253 bp, Luteibacter rhizovicinus
tacggagggtgcaagcgttaatcggaattactgggcgtaaagcgtgcgtaggcggttcgttaagtctgctgtgaaagccccgggctcaacctgggaatggcagtggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacagg

SEQ ID NO: 398 - DNA, 254 bp, Unknown
  Kingdom: Bacteria, Phylum: Actinobacteria, Class: Actinobacteria, Order: Actinomycetales, Family: Corynebacteriaceae, Genus: Corynebacterium
tacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacagg

SEQ ID NO: 399 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggggctagcgttgttcggaattactgggcgtaaagcgcacgtaggcggctttgtaagtaagaggtgaaagcctggtgctcaacaccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 400 - DNA, 253 bp, Unknown
  Kingdom: Bacteria, Phylum: Proteobacteria, Class: Betaproteobacteria, Order: Burkholderiales, Family: Comamonadaceae
tacgtagggtgcaagcgttaatcggaattactgggcgtaaagcgtgcgcaggcggttctataagacagatgtgaaatccccgggctcaacctgggaactgcatttgtgactgtagagctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 401 - DNA, 253 bp, Unknown
  Kingdom: Bacteria, Phylum: Proteobacteria, Class: Betaproteobacteria, Order: Burkholderiales, Family: Oxalobacteraceae, Genus: Janthinobacterium
tacggagggtgcaagcgttaatcggaattactgggcgtaaagcgtgcgcaggcggttttgtaagtctgttgtgaaatccccgggcttaacctgggaatggcaatggagactgcaaggctagagtttggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 402 - DNA, 253 bp, Unknown
  Kingdom: Bacteria, Phylum: Proteobacteria, Class: Gammaproteobacteria, Order: Xanthomonadales, Family: Xanthomonadaceae, Genus: Rhodanobacter
tacgaagggtgcaagcgttaatcggaattactgggcgtaaagggtgcgtaggcggttcgttaagtctgtcgtgaaatccccgggctcaacctgggaatggcgatggatactggcgagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 403 - DNA, 253 bp, Acinetobacter johnsonii
tacagagggtgcgagcgttaatcggatttactgggcgtaaagcgtgcgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 404 - DNA, 253 bp, Unknown
  Kingdom: Bacteria, Phylum: Proteobacteria, Class: Alphaproteobacteria, Order: Sphingomonadales, Family: Sphingomonadaceae, Genus: Kaistobacter
tacggagggggctagcgttgttcggaattactgggcgtaaagcgcacgtaggcggctttgtaagttagaggtgaaagcccggggctcaactccggaattgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacagg

SEQ ID NO: 405 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggggctagcgttgttcggaattactgggcgtaaagcgcacgtaggcggctttgcaagttagaggtgaaagcccggggctcaaccccggaattgcctttaagactgcagggctagaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 406 - DNA, 253 bp, Unknown
  Kingdom: Bacteria, Phylum: Fibrobacteres, Class: Fibrobacteria, Order: 258ds10, Family:
tacgaggggggcaaatgttgttcggaatcactgggcgtaaagggagcgtaggcgggttcttaagttaggtgtttaatcccggggcccaaccccggaccggcacttaaaactgggaatcttgaatagtggagaggtcggtggaattgggggtgtagcggtggaatgcgtagagatccccaagaacaccagttgcgaaggcggccgactggacacatattgacgctgaggctcgaaagcatggggagcaaacagg

SEQ ID NO: 407 - DNA, 254 bp, Unknown
  Kingdom: Bacteria, Phylum: Actinobacteria, Class: Actinobacteria, Order: Actinomycetales, Family: Corynebacteriaceae, Genus: Corynebacterium
tacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacagg

SEQ ID NO: 408 - DNA, 254 bp, Unknown
  Kingdom: Bacteria, Phylum: Proteobacteria, Class: Gammaproteobacteria, Order: Pseudomonadales, Family: Moraxellaceae, Genus: Enhydrobacter
tacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacagg

SEQ ID NO: 409 - DNA, 253 bp, Unknown
  Kingdom: Bacteria, Phylum: Firmicutes, Class: Bacilli, Order: Bacillales, Family: Bacillaceae, Genus: Geobacillus
tacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacagg

SEQ ID NO: 410 - DNA, 253 bp, Unknown
  Kingdom: Bacteria, Phylum: Bacteroidetes, Class: Cytophagia, Order: Cytophagales, Family: Cytophagaceae, Genus: Hymenobacter
tacggagggtgcaagcgttgtccggatttattgggtttaaagggtgcgtaggcggctgattaagtctggggtgaaagcccgttgctcaacaacggaactgccctggaaactggttagcttgagtacagacgagggtggcggaatggatgctgtagcggtgaaatgcatagatagcatccagaaccccgattgcgaaggcagctgcctagactgtaactgacgctgaggcacgaaagcgtggggagcgaacagg

SEQ ID NO: 411 - DNA, 253 bp, Unknown
  Kingdom: Bacteria, Phylum: Actinobacteria, Class: Actinobacteria, Order: Actinomycetales, Family: Geodermatophilaceae
tacgtagggtgcaagcgttgtccggaattattgggcgtaaagagctcgtaggcggtttgtcgcgtcggctgtgaaagcccggagctcaactccgggtctgcagtcgatacgggcagacttgagtgttgcaggggagactggaattcctggtgtagcggtgaaatgcgcagatatcaggaggaacaccggtggcgaaggcgggtctctgggcaacaactgacgctgaggagcgaaagcgtggggagcgaacagg

SEQ ID NO: 412 - DNA, 253 bp, Unknown
  Kingdom: Bacteria, Phylum: Actinobacteria, Class: Actinobacteria, Order: Actinomycetales, Family: Mycobacteriaceae, Genus: Mycobacterium
tacgtagggtccgagcgttgtccggaattactgggcgtaaagagctcgtaggtggtttgtcgcgttgttcgtgaaaactcacagcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 413 - DNA, 253 bp, Unknown
  Kingdom: Bacteria, Phylum: Proteobacteria, Class: Alphaproteobacteria, Order: Rhizobiales, Family: Hyphomicrobiaceae, Genus: Devosia
tacgaagggggctagcgttgttcggatttactgggcgtaaagcgcacgtaggcggattgttaagtcaggggtgaaatcctggagctcaactctagaactgcctttgatactggcaatctagagtccggaagaggtgagtggaactcctagtgtagaggtggaattcgtagatattaggaagaacaccagtggcgaaggcggctcactggtccggtactgacgctgaggcacgaaagcgcggggatcaaacagg

SEQ ID NO: 414 - DNA, 253 bp, Sphingomonas wittichii
tacggagggggctagcgttgttcggaattactgggcgtaaagcgcacgtaggcggccgaataagtcagaggtgaaagcctggggctcaaccccagaactgcctttgagactgtatggctagaacgtcggagaggtgagtggaattccgagtgtagaggtgaaattcgtagatattcggaagaacaccagtggcgaaggcggctcactggacgactgttgacgctgaggtgcgaaagcgtggggagcaaacagg

SEQ ID NO: 415 - DNA, 253 bp, Sphingomonas wittichii
tacggagggggctagcgttgttcggaattactgggcgtaaagcgcacgtaggcggctttgtaagtcaggggtgaaagcccggagctcaactccggaattgcctttgagactgcatcgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacagg

SEQ ID NO: 416 - DNA, 253 bp, Pantoea ananatis
tacggagggtgcaagcgttaatcggaattactgggcgtaaagcacacgcaggcggtctgttaagtcagatgtgaaatccccgggcttaacctgggaactgcatttgaaactggcaggcttgagcctcgtagaggggggtagaattccaggtgtagcggtgaaatgcgtagggatctggaggaataccggtggcgaaggcggccccctggacgaagactgacgctcaggtgcgaaagcgtggggagcgaacaac

SEQ ID NO: 417 - DNA, 253 bp, Unknown
  Kingdom: Bacteria, Phylum: Proteobacteria, Class: Alphaproteobacteria, Order: Caulobacterales, Family: Caulobacteraceae
tacgaagggggctagcgttgctcggaattactgggcgtaaagggagcgtaggcggacatttaagtcaggggtgaaatcccggggctcaacctcggaattgcctttgatactgggtgtcttgagtatgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 418 - DNA, 253 bp, Sphingopyxis alaskensis
tacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 419 - DNA, 253 bp, Bacillus racemilacticus
tacgtaggtggcaagcgttgtccggaattattgggcgtaaagcgcgcgcaggcggtttcttaagtctgatgtgaaagcccccagctcaactggggagggtcattggaaactgggaaacttgagtacagaagaggagagtagaattccacgtgtagcggtgaaatgcgtagagatgtggaggaataccagtggcgaaggcggctctctggtctgtaactgacgctgaggcgcgaaagcgtggggagcaaacagg

SEQ ID NO: 420 - DNA, 253 bp, Unknown
  Kingdom: Bacteria, Phylum: Bacteroidetes, Class: Sphingobacteriia, Order: Sphingobacteriales, Family: Sphingobacteriaceae
tacggaggatccaagcgttatccggatttattgggtttaaagggtgcgtaggcggccaattaagtcaggggtgaaagacggtagcttaactatcgcagtgcctttgatactgattggcttgaatccacttgaggtaggcggaatgtgacaagtagcggtgaaatgcatagatatgtcacagaacaccaattgcgaaggcagcttactaaagtggcattgacgctgaggcacgaaagcgtggggatcaaacagg

SEQ ID NO: 421 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggagctagcgttgttcggaattactgggcgtaaagcgtacgtaggcggctttgtaagttagaggtgaaagcctggagctcaactccagaattgcctttaagactgcatcgcttgaatcctggagaggtgagtgggattccgagtgtagaggtgaaattcgtagatattcggaagaacaccagtggcgagggcggctcactggacaggtattgacgctgaggtacgaaagcgtggggagcaaacagg

SEQ ID NO: 422 - DNA, 253 bp, Unknown
  Kingdom: Bacteria, Phylum: Bacteroidetes, Class: Cytophagia, Order: Cytophagales, Family: Cytophagaceae
tacgtaggtggcaagcgttgtccggatttattgggtttaaagggtgcgtaggcggtctattaagtcagtggtgaaatatcgcagcttaactgtgagggtgccattgatactgatggacttgagtgaagtcgaagtaggcggaattgacggtgtagcggtgaaatgcttagatatcgtcaagaacaccgatagtgaagacagcttactaggcttatactgacgctgaggcacgaaagtgtggggatcaaacagg

SEQ ID NO: 423 - DNA, 252 bp, Unknown
  Kingdom: Bacteria, Phylum: Firmicutes, Class: Bacilli, Order: Lactobacillales, Family: Streptococcaceae, Genus: Streptococcus
tacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacagg

SEQ ID NO: 424 - DNA, 253 bp, Unknown
  Kingdom: Bacteria, Phylum: Proteobacteria, Class: Betaproteobacteria, Order: Burkholderiales, Family: Comamonadaceae, Genus: Comamonas
tacgtagggtgcaagcgttaatcggaattactgggcgtaaagcgtgcgcaggcggttttgtaagacagtggtgaaatccccgggctcaacctgggaactgccattgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 425 - DNA, 253 bp, Unknown
  Kingdom: Bacteria, Phylum: Actinobacteria, Class: Actinobacteria, Order: Actinomycetales, Family: Microbacteriaceae
tacgtagggtgcaagcgttatccggaattattgggcgtaaagagctcgtaggcggtctgtcgcgtctgctgtgaaaaccggaggctcaacccccggcctgcagtgggtacgggcaaactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 426 - DNA, 253 bp, Unknown
  Kingdom: Bacteria, Phylum: Firmicutes, Class: Clostridia, Order: Clostridiales, Family: Clostridiaceae, Genus: Clostridium
tacgtaggtggcaagcgttgtccggatttactgggcgtaaagggagcgtaggtggatatttaagtgggatgtgaaatacctgagcttaacttgggtgctgcattccaaactggatatctagagtgcgggagaggaaagtggaattcctagtgtagcggtgaaatgcgtagagattaggaagaaccccagtggcgaaggcgactttctggactgtaactgacactgaggctcgaaagcgtggggagcaaacagg

SEQ ID NO: 427 - DNA, 253 bp, Algoriphagus terrigena
tacggagggtgcaagcgttgtccggatttattgggtttaaagggtgcgtaggcggctatttaagtcagcggtgaaagacatcggctcaaccgatgcagtgccattgatactggatagcttgagtgttggaggggtacatggaattgatggtgtagcggtgaaatgcatagataccatcaggaacaccgatagcgaaggcattgtactggccaacaactgacgctgaggcacgaaagcatgggtagcgaacagg

SEQ ID NO: 428 - DNA, 253 bp, Unknown
  Kingdom: Bacteria, Phylum: Thermi, Class: Deinococci, Order: Deinococcales, Family: Deinococcaceae, Genus: Deinococcus
tacggagggtgcaagcgttacccggaatcactgggcgtaaagggcgtgtaggcgggaacttaagtctggttttaaagaccggggctcaacctcggggatggactggatactgggtttcttgatctctggagaggtaaccggaattcctggtgtagcggtggaatgcgtagataccaggaggaacaccaatggcgaaggcaggttactggacagaagatgacgctgaggcgcgaaagtgtggggagcgaaccgg

SEQ ID NO: 429 - DNA, 253 bp, Unknown
  Kingdom: Bacteria, Phylum: Actinobacteria, Class: Thermoleophilia, Order: Solirubrobacterales, Family:
tacgtagggagcaagcgttgtccggaatcattgggcgtaaagcgcgcgtaggtggcttcgtaagtccgttgtgaaagtcaaaggctcaacctttgaatgccgatggatactgcggagctagagtacggaagaggcgagtggaattcctggtgtagcggtggaatgcgcagatatcaggaggaacaccaatagcgaaggcagctcgctgggacgttactgacactaaggcgcgaaagcgtggggagcgaacagg

SEQ ID NO: 430 - DNA, 253 bp, Nocardioides plantarum
tacgtagggtgcgagcgttgtccggaattattgggcgtaaagggctcgtaggcggtttgttgcgtcgggagtgaaaacactgggcttaaccgagtgcttgctttcgatacgggcagacttgaggcattgaggggagaacggaattcctggtgtagcggtgaaatgcgcagatatcaggaggaacaccggtggcgaaggcggttctctggcaatgttctgacgctgaggagcgaaagtgtggggagcgaacagg

SEQ ID NO: 431 - DNA, 253 bp, Quadrisphaera granulorum
tacgtagggtgcaagcgttgtccggaattattgggcgtaaagagctcgtaggcggtttgtcgcgtctgctgtgaaaacgcggggctcaactccgcgcctgcagtgggtacgggcagactagagtgcagtaggggagactggaattcctggtgtagcggtggaatgcgcagatatcaggaggaacaccggtggcgaaggcgggtctctgggctgtaactgacgctgaggagcgaaagcgtgggtagcgaacagg

SEQ ID NO: 432 - DNA, 253 bp, Unknown
  Kingdom: Bacteria, Phylum: Bacteroidetes, Class: Cytophagia, Order: Cytophagales, Family: Cytophagaceae
tacgtaggtggcaagcgttgtccggatttattgggtttaaagggtgcgtaggcggttctataagtcagtggtgaaatccggcagctcaactgtcgatgtgccattgatactgcagaacttgagtacagacgaggtaggcggaattgacggtgtagcggtgaaatgcttagatatcgtcaagaacaccgatagcgaaggcagcttactagactgtaactgacgctgatgcacgaaagtgtggggatcaaacagg

SEQ ID NO: 433 - DNA, 254 bp, Unknown
  Kingdom: Bacteria, Phylum: Proteobacteria, Class: Gammaproteobacteria, Order: Enterobacteriales, Family: Enterobacteriaceae, Genus: Erwinia
gacgggggggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 434 - DNA, 253 bp, Unknown
  Kingdom: Bacteria, Phylum: Proteobacteria, Class: Gammaproteobacteria, Order: Enterobacteriales, Family: Enterobacteriaceae
tacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatgtgggggaacaccgatggcgaaggcggccccctggacaaagactgacgctcaggtgcgaaagcgtggggagcaaacagg

SEQ ID NO: 435 - DNA, 253 bp, Sphingomonas azotifigens
tacgtagggtgcgagcgttattcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 436 - DNA, 253 bp, Unknown
  Kingdom: Bacteria, Phylum: Proteobacteria, Class: Betaproteobacteria, Order: Burkholderiales, Family: Alcaligenaceae, Genus: Achromobacter
tacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacagg

SEQ ID NO: 437 - DNA, 253 bp, Unknown
  Kingdom: Bacteria, Phylum: Proteobacteria, Class: Alphaproteobacteria, Order: Rhizobiales, Family: Methylobacteriaceae, Genus: Methylobacterium
tacgaagggggctagcgttgctcggaatcactgggcgtaaagggcgcgtaggcggccatttaagtcgggggtgaaagcctgtggctcgaccacagaattgccttcgatactggatggcttgggttcggtagaggttggtggaactgcgagtgtagaggtgaaattcgtagatattcgcaagaacaccggtggcgaaggcggccaactggaccgacactgacgctgaggcgcgaaagcgtggggagcaaacagg

SEQ ID NO: 438 - DNA, 253 bp, Unknown
  Kingdom: Bacteria, Phylum: Proteobacteria, Class: Gammaproteobacteria, Order: Xanthomonadales, Family: Xanthomonadaceae
tacgaagggtgcaagcgttactcggaattactgggcgtaaagcgtgcgtaggtggttcgttaagtctgatgtgaaagccctgggctcaacctgggaattgcattggatactggcgggctagagtgcggtagaggatggcggaattcccggtgtagcagtgaaatgcgtagagatcgggaggaacatctgtggcgaaggcggccatctggaccagcactgacactgaggcacgaaagcgtggggagcaaacagg

SEQ ID NO: 439 - DNA, 253 bp, Unknown
  Kingdom: Bacteria, Phylum: Proteobacteria, Class: Alphaproteobacteria, Order: Sphingomonadales, Family: Sphingomonadaceae, Genus: Kaistobacter
tacggagggggctagcgttgttcggaattactgggcgtaaagcgcacgtaggcggctttgtaagttagaggtgaaagcccggagctcaactccggaactgcctttaagactgcatcgctagaacgttggagaggtaagtggaattccgagtgtagaggtgaaattcgtagatattcggaagaacaccagtggcgaaggcgacttactggacaactgttgacgctgaggtgcgaaagcgtggggagcaaacagg

SEQ ID NO: 440 - DNA, 253 bp, Bosea genosp.
tacgaagggggctagcgttgctcggaatcactgggcgtaaagggtgcgtaggcgggtttctaagtcagaggtgaaatcctggagctcaactccagaactgcctttgatactggaagtcttgagtatgggagaggtgagtggaactgcgagtgtggaggtgaaattcgtagatattcgcaagaacaccagtggcgaaggcggctcactggcccattactgacgctgaggcacgaaagcgtggagagcaaacagg

SEQ ID NO: 441 - DNA, 252 bp, Unknown
  Kingdom: Bacteria, Phylum: Firmicutes, Class: Bacilli, Order: Bacillales, Family: Paenibacillaceae, Genus: Brevibacillus
tacgtaggtggcaagcgttgtccggaattattgggcgtaaagcgcgcgcaggcggctatgtaagtctggtgttaaagcccggggctcaaccccggttcgcattggaaactgcgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacagg

SEQ ID NO: 442 - DNA, 253 bp, Sphingomonas wittichii
tacggagggggctagcgttgttcggaattactgggcgtaaagcgcacgtaggcggctttttaagtcagaggtgaaagcccggggctcaaccccggaattgcctttgagactgggaggcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacagg

SEQ ID NO: 443 - DNA, 253 bp, Unknown
  Kingdom: Bacteria, Phylum: Proteobacteria, Class: Betaproteobacteria, Order: Burkholderiales, Family: Comamonadaceae, Genus: Methylibium
tacgtagggtgcaagcgttaatcggaattactgggcgtaacgcgtgcgcaggcggctttgcaagacagatgtgaaatccccgggcttaacctgggaactgcatttgtgactgcatggctcgagtacggtagagggggatggaattccgcgtgtagcagtgaaatgcgtagatatgcggaggaacaccgatggcgaaggcagtcccctggacctgtactgacgctcatgcacgaaagcgtggggagcaaacagg

SEQ ID NO: 444 - DNA, 253 bp, Unknown
  Kingdom: Bacteria, Phylum: Actinobacteria, Class: Actinobacteria, Order: Actinomycetales, Family: Dermabacteraceae, Genus: Brachybacterium
tacgtagggcgcaagcgttgtccggaattattgggcgtaaagagctcgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgaggagcgaaagcatgggtagcgaacagg

SEQ ID NO: 445 - DNA, 253 bp, Unknown
  Kingdom: Bacteria, Phylum: Actinobacteria, Class: Actinobacteria, Order: Actinomycetales, Family: Nocardioidaceae
tacgtagggtgcgagcgttgtccggaattattgggcgtaaagggctcgtaggcggtctgttgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 446 - DNA, 253 bp, Methylobacterium organophilum
tacgaagggggctagcgttgctcggaatcactgggcgtaaagggcgcgtaggcggtcttttaagtcgggggtgaaagcctgtggctcaaccacagaattgccttcgatactgggagacttgagttcggaagaggttggtggaactgcgagtgtagaggtgaaattcgtagatattcgcaagaacaccggtggcgaaggcggccaactggtccgacactgacgctgaggcgcgaaagcgtggggagcaaacagg

SEQ ID NO: 447 - DNA, 253 bp, Unknown
  Kingdom: Bacteria, Phylum: Proteobacteria, Class: Betaproteobacteria, Order: Burkholderiales, Family: Alcaligenaceae, Genus: Pigmentiphaga
tacgtagggtgcaagcgttaatcggaattactgggcgtaaagcgtgcgcaggcggttcggaaagaaagatgtgaaatcccagggctcaaccttggaactgcatttttaactcccgaactagagtatgtcagaggggggtggaattccacgtgtagcagtgaaatgcgtagatatgtggaggaacaccgatggcgaaggcagccccctgggataatactgacgctcatgcacgaaagcgtggggagcaaacagg

SEQ ID NO: 448 - DNA, 253 bp, Unknown
  Kingdom: Bacteria, Phylum: Bacteroidetes, Class: Flavobacteriia, Order: Flavobacteriales, Family: Flavobacteriaceae, Genus: Flavobacterium
tacggagggtccaagcgttatccggaatcattgggtttaaagggtccgtaggcggttttataagtcagtggtgaaatccggtagctcaactatcgaacggccattgatactgtagaacttgaattattgtgaagtaactagaatatgtagtgtagcggtggaatgcttagatattacatggaataccaattgcgaaggcaggttactaacaatacattgacgctgatggacgaaagcgtggggagcgaacagg

SEQ ID NO: 449 - DNA, 254 bp, Unknown
  Kingdom: Bacteria, Phylum: Actinobacteria, Class: Actinobacteria, Order: Actinomycetales, Family: Corynebacteriaceae, Genus: Corynebacterium
tacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggagggacaccaatggcgaaggcaggtctctgggcagtaactgacgctgaggagcgaaagcatgggtagcgaacagg

SEQ ID NO: 450 - DNA, 253 bp, Unknown
  Kingdom: Bacteria, Phylum: Actinobacteria, Class: Actinobacteria, Order: Actinomycetales, Family:
tacgtagggtgcaagcgttgtccggaattattgggcgtaaagagctcgtaggcggctcgtcgcgtctgctgtgaaagcccggggcttaaccccgggtctgcagtgggtacgggcgggctagagtgcggtaggggagactggaattcctggtgtagcggtgaaatgcgcagatatcaggaggaacaccggtggcgaaggcgggtctctgggccgtaactgacgctgaggagcgaaagcatgggtagcgaacagg

SEQ ID NO: 451 - DNA, 253 bp, Unknown
  Kingdom: Bacteria, Phylum: Bacteroidetes, Class: Sphingobacteriia, Order: Sphingobacteriales, Family: Sphingobacteriaceae
tacggaggatccaagcgttatccggatttattgggtttaaagggtgcgtaggcggcctattaagtcaggggtgaaagacggtagcttaactatcgcagtgcctttgatactgatgggcttgaatggactagaggtaggcggaatgtgacaagtagcggtgaaatgcatagatatgtcacagaacaccaaatgcgaaggcagcttactatggtttaattgacgctgaggcacgaaagcgtggggatcaaacagg

SEQ ID NO: 452 - DNA, 253 bp, Unknown
  Kingdom: Bacteria, Phylum: Acidobacteria, Class: Chloracidobacteria, Order: RB41, Family: Ellin6075
tacgtagggaccaagcgttgttcggatttactgggcgtaaagggcgcgtaggcggcgtggtaagtcacttgtgaaatctccgagcttaactcggaacggtcaagtgatactgctgtgctagagtgcagaaggggcaatcggaattcttggtgtagcggtgaaatgcgtagatatcaagaggaacacctgaggtgaagacgggttgctgggctgacactgacgctgaggcgcgaaagctagggtagcaaacggg

SEQ ID NO: 453 - DNA, 253 bp, Unknown
  Kingdom: Bacteria, Phylum: Proteobacteria, Class: Alphaproteobacteria, Order: Rhizobiales, Family: Hyphomicrobiaceae, Genus: Devosia
tacgaagggggctagcgtcgttcggatttactgggagtaaagcgcacgtaggcggattgttaagtcaggggtgaaatcctggagctcaactccagaactgcctttgatactggcaatctcgagcccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 454 - DNA, 253 bp, Unknown
  Kingdom: Bacteria, Phylum: Proteobacteria, Class: Gammaproteobacteria, Order: Xanthomonadales, Family: Xanthomonadaceae, Genus: Dokdonella
tacgaagggtgcaagcgttactcggtatcactgggcataaagcgtgcgtaggcggttcgttgagtctgctgtgaaagccctgggctcaacctgggaactgcagtggatactggcgggctagagtgtgatagaggatggtggaattcccggagtagcggtgaaatgcgtagagatcgggaggaacaccagtggcgaaggcggccatctggatcaacactgacgctgaggcacgaaagcgtggggagcaaacagg

SEQ ID NO: 455 - DNA, 254 bp, Unknown
  Kingdom: Bacteria, Phylum: Actinobacteria, Class: Acidimicrobiia, Order: Acidimicrobiales, Family:
tacgtagggtgcaagcgttgtccggatttattgggcgtaaagagctcgtaggcggttttgaaagtcaggtgtgaaacctccaggctcaacctggagacgccacttgagacttcaatgactggagttcggtaggggtaagcggaattcctggtgtagcggtgaaatgcacagatatcaggaggaacaccgatggcgaaggcagcttactgggccgatactgacgctgaggagcgaaagcgtggggagcgaacagg

SEQ ID NO: 456 - DNA, 253 bp, Unknown
  Kingdom: Bacteria, Phylum: Actinobacteria, Class: Actinobacteria, Order: Actinomycetales, Family: Nocardiaceae, Genus: Rhodococcus
tacgtagggtgcaagcgttgtccggaattactgggcgtaaagagctcgtaggcggtttgtcgcgtcgtctgtgaaaaccagcagctcaactgttggcttgcaggcgatacgggcagacttgagtatttcaggggagactggaattcctggtgtagcggtgaaatgcgcagatatcaggaggaacaccggtggcgaaggcgggtctctgggaaataactgacgctgaggagcgaaagcgtgggtagcgaacagg

SEQ ID NO: 457 - DNA, 253 bp, Unknown
  Kingdom: Bacteria, Phylum: Bacteroidetes, Class: Cytophagia, Order: Cytophagales, Family: Cytophagaceae, Genus: Hymenobacter
tacggagggtgcgagcgttgtccggatttattgggtttaaagggtgcgtaggcggccttataagtccggggtgaaagcccgctgctcaacagcggaactgccctggatactgtgaggcttgagtacagacgaggttggcggaatggaccgagtagcggtgaaatgcatagatacggtccagaaccccgattgcgaaggcagctgactaggctgttactgacgctgaggcacgaaagcgtggggagcgaacagg

SEQ ID NO: 458 - DNA, 253 bp, Unknown
  Kingdom: Bacteria, Phylum: Proteobacteria, Class: Gammaproteobacteria, Order: Pseudomonadales, Family: Moraxellaceae, Genus: Acinetobacter
tacagagggtgcgagcgttaatcggatttactgggcgtaaagcgtgcgtaggcggctaattgagtcggatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtacgaaagcatggggagcaaacagg

SEQ ID NO: 459 - DNA, 252 bp, Pantoea ananatis
gacgggggggcaagtgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 460 - DNA, 253 bp, Bacillus coagulans
tacgtaggtggcaagcgttgtccggaattattgggcgtaaagcgcgcgcaggcggcttcttaagtctgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 461 - DNA, 253 bp, Unknown
  Kingdom: Bacteria, Phylum: Actinobacteria, Class: Actinobacteria, Order: Actinomycetales, Family: Kineosporiaceae, Genus: Kineosporia
tacgtagggtgcaagcgttgtccggaattattgggcgtaaagagctcgtaggcggtctgtcgcgtctgctgtgaaaacctagggcttaactctgggcgtgcagtgggtacgggcagactagagtgcggtaggggagactggaattcctggtgtagcggtgaaatgcgcagatatcaggaggaacaccggtggcgaaggcgggtctctgggccgtaactgacgctgaggagcgaaagcatggggagcgaacagg

SEQ ID NO: 462 - DNA, 252 bp, Unknown
  Kingdom: Bacteria, Phylum: Firmicutes, Class: Bacilli, Order: Bacillales, Family: Paenibacillaceae, Genus: Paenibacillus
tacgtagggggcaagcgttgtccggaattattgggcgtaaagcgcgcgcaggcggccttgtaagtctgtcgtttaaactcggagctcaacttcgagtcgcgatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 463 - DNA, 253 bp, Unknown
  Kingdom: Bacteria, Phylum: TM6, Class: SJA-4, Order: , Family:
tacgagaggtgcaagcgttattcggaataattgggcgtaaagggtgcgtagacggtccgctaagtctgttgttaaatctttcggcttaaccgaaaatctgcaatggaaactggtaggctagagtgtgagagagagaagtggaattcttggagtagcggtaaaatgcgtagatctcaagaggaacaccgatggcgaaggcagcttcttggctcactactgacgttgaggcacgaaagcgtggggagcaaacagg

SEQ ID NO: 464 - DNA, 253 bp, Unknown
  Kingdom: Bacteria, Phylum: Proteobacteria, Class: Alphaproteobacteria, Order: Rhizobiales, Family: Hyphomicrobiaceae, Genus: Rhodoplanes
tacgaagggggctagcgttgctcggaattactgggcgtaaagcgcacgtaggcggctttctaagtcgggggtgaaatcctggagctcaactccagaactgccttcgatactggagagctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacagg

SEQ ID NO: 465 - DNA, 253 bp, Brevundimonas diminuta
tacgaagggggctagcgttgctcggaattactgggcgtaaagggcgcgtaggcggatcgttaagtcagaggtgaaatcccggagctcaacttcggaactgcctttgatactggcgatcttgagtgtgagagaggtatgtggaactccgagtgtagaggtgaaattcgtagatattcggaagaacaccagtggcgaaggcgacatactggctcattactgacgctgaggcgcgaaagcgtggggagcaaacagg

SEQ ID NO: 466 - DNA, 253 bp, Pseudomonas viridiflava
tacagagggtgcaagcgttaatcggaattactgggcgtaaagcgcgcgtaggtggtttgttaagttggatgtgaaatccccgggctcaacctgggaactgcatctaagactggcaagctagggtagggcagagggtggtggaatttcctgtgtagcggtgaagtgcgtagatattggaaggaacaccagtggcgagggcgaccacctgggctcatactgacactgaggtgcgaaagcgtggggagcaaacagg

SEQ ID NO: 467 - DNA, 253 bp, Unknown
  Kingdom: Bacteria, Phylum: Actinobacteria, Class: Actinobacteria, Order: Actinomycetales, Family: Micromonosporaceae
gacgtagggcgcgagcgttgtccggatttattgggcgtaaagagctcgtaggcggcttgtcgcgtcgactgtgaaaacccgcggctcaaccgcgggcctgcagccgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacagg

SEQ ID NO: 468 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggagctagcgttgttcggaattactgggcgtaaagcgcacgtaggcggctttgtaagttaggggtgaaagcctggagctcaacttcagaattgcccttaagactgcatcgcttgaatccaggagaggtgagtggaactccgagtgtagaggtgaaattcgtagacattcggaagaacaccagtggcgaaggcggctcactggactggtattgacgctgaggtgcgaaagcgtggggagcaaacagg

SEQ ID NO: 469 - DNA, 253 bp, Unknown
  Kingdom: Bacteria, Phylum: Bacteroidetes, Class: Cytophagia, Order: Cytophagales, Family: Cytophagaceae
tacgtaggtggcaagcgttgtccggatttattgggtttaaagggtgcgtaggcggtcttataagtcagtgctgaaatatcccggcttaaccgggagggtggcattgatactgtaggacttgagtaaagttgaggtaggcggaattgacggtgtagcggtgaaatgcttagatatcgtcaagaacaccgatagtgaagacagcttactaaactttaactgacgctgaggcacgaaagtgtggggatcaaacagg

SEQ ID NO: 470 - DNA, 253 bp, Unknown
  Kingdom: Bacteria, Phylum: Proteobacteria, Class: Gammaproteobacteria, Order: Xanthomonadales, Family: Xanthomonadaceae, Genus: Lysobacter
tacgaagggtgcaagcgttactcggaattactgggcgtaaagcgtgcgtaggtggttcgttaagtctgatgtgaaagccctgggctcaacctgggaatggcattggatactggcgacctagagtgcggtagaggggtgtggaattcccggtgtagcagtgaaatgcgtagatatcgggaggaacatctgtggcgaaggcgacaccctggaccagcactgacactgaggcacgaaagcgtggggagcaaacagg

SEQ ID NO: 471 - DNA, 253 bp, Unknown
  Kingdom: Bacteria, Phylum: Proteobacteria, Class: Alphaproteobacteria, Order: Rhodospirillales, Family: Acetobacteraceae
tacgaagggggctagcgttgctcggaatgactgggcgtaaagggcgcgtaggcggttcgtacagtcagacgtgaaattcccgggctcaacctgggggctgcgtttgatacgtgcgggcttgagttcggaagagggtcgtggaattcccagtgtagaggtgaaattcgtagatattgggaagaacaccggtggcgaaggcggcgacctggtccgatactgacgctgaggcgcgaaagcgtggggagcaaacagg

SEQ ID NO: 472 - DNA, 253 bp, Unknown
  Kingdom: Bacteria, Phylum: Proteobacteria, Class: Betaproteobacteria, Order: , Family:
tacgtagggtgcaggcgttaatcggaattactgggcgtaaagcgtgcgcaggcggtttgttaagacaggtgtgaaatccccgagcttaacttgggaattgcgcttgtaactggcaagctagagtgtggcagaggggggtggaattccacgtgtagcagtgaaatgcgtagatatgtggaggaacaccgatggcgaaggcagccccctgggttaacactgacgctcatgcacgaaagcgtgggtagcaaacagg

SEQ ID NO: 473 - DNA, 253 bp, Unknown
  Kingdom: Bacteria, Phylum: Actinobacteria, Class: Actinobacteria, Order: Actinomycetales, Family: Nocardioidaceae
tacgtagggtgcgagcgttgtccggaattattgggcgtaaagggctcgtaggcggtttgtcgcgtcgggagtgaaaacgccgtgcttaacacggcgcttgctttcgatacgggcagactagaggtattcaggggagaacggaattcctggtgtagcggtgaaatgcgcagatatcaggaggaacaccggtggcgaaggcggttctctgggaatgacctgacgctgaggagcgaaagtgtggggagcgaacagg

SEQ ID NO: 474 - DNA, 253 bp, Alcaligenes faecalis
tacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattccacgtgtagcagtgaaatgcgtagatatgtggaggaataccgatggcgaaggcagccccctgggataatactgacgctcagacacgaaagcgtggggagcaaacagg

SEQ ID NO: 475 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacgtagggcgcaagcgttaatcggaattactgggcgtaaagcgcgcgtaggtggtttgttaagttggatgtgaaatccccgggcttaacctgggaactgcatccaaaactggcaagctagagtatggtagagggtggtggaatttcctgtgtagcggtgaaatgcgtagatataggaaggaacaccagtggcggaggcgaccacctggactgatactgacactgaggtgcgaaagcgtggggagcaaacagg

SEQ ID NO: 476 - DNA, 253 bp, Bdellovibrio bacteriovorus
gacgagggatcctagcgttgttcggaatcattgggcgtaaagcgggtgtaggtggctatgtaagtcgagtgtgaaagcctggggctcaaccccagaagtgcattcgatactgcgtagcttgagtggtagagaggatagtagaattgttggtgtagtggtgaaatacgtagatatcaacaggaataccggtggcgaaggcggctatctggctacacactgacactcagacccgaaagtgcggggatcaaacagg

SEQ ID NO: 477 - DNA, 253 bp, Unknown
  Kingdom: Bacteria, Phylum: Firmicutes, Class: Bacilli, Order: Lactobacillales, Family: Enterococcaceae, Genus: Enterococcus
tacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacagg

SEQ ID NO: 478 - DNA, 253 bp, Unknown
  Kingdom: Bacteria, Phylum: Acidobacteria, Class: Acidobacteria-6, Order: iii1-15, Family:
tacagagggggcaagcgttgttcggaattactgggcgtaaagggcgcgtaggcggccttctaagtcgaacgtgaaatccccgggctcaacccgggaactgcgtccgagactggaaggctcgaatccgggagagggatgtggaattccaggtgtagcggtgaaatgcgtagatatctggaggaacatcggtggcgaaggcggcatcctggaccggtattgacgctgaggcgcgaaagccaggggagcaaacggg

SEQ ID NO: 479 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacagagggtgcaagcgttaatcggaattactgggcgtaaagcgcgcgtaggtggttcagtaagttgaatgtgaaatccccgggctcaacctgggaactgcatccaaaactgctgagctagagtatggtagagggtggtggaatttcctgtgtagcggtgaaatgcgtagatataggaaggaacaccggtggcgaaggcgaccacctggactgatactgacactgaggtgcgaaagcgtggggagcaaacagg

SEQ ID NO: 480 - DNA, 253 bp, Unknown
  Kingdom: Bacteria, Phylum: Proteobacteria, Class: Alphaproteobacteria, Order: Rhodobacterales, Family: Rhodobacteraceae, Genus: Rhodobacter
tacggagggggctagcgttattcggaattactgggcgtaaagcgcacgtaggcggatcagaaagtcagaggtgaaatcccagggctcaaccttggaactgcctttgaaacttctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 481 - DNA, 253 bp, Pseudomonas stutzeri
tacgaagggtgcaagcgttaatcggaattactgggcgtaaagcgcgcgtaggtggttcgttaagttggatgtgaaagccccgggctcaacctgggaactgcatccaaaactggcgagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacagg

SEQ ID NO: 482 - DNA, 253 bp, Unknown
  Kingdom: Bacteria, Phylum: Proteobacteria, Class: Betaproteobacteria, Order: Burkholderiales, Family: Comamonadaceae
tacgtagggtgcaagcgttaatcggaattactgggcgtaaagcgtgcgcaggcggttgtgcaagacagatgtgaaatccccgggctcaacctgggaactgcatttgtgactgcacggctagagtgcggcagagggagatggaattccgcgtgtagcagtgaaatgcgtagatatgcggaggaacaccgatggcgaaggcaatctcctgggcctgcactgacgctcatgcacgaaagcgtggggagcaaacagg

SEQ ID NO: 483 - DNA, 253 bp, Actinomadura vinacea
tacgtagggcgcaagcgttgtccggaattattgggcgtaaagagctcgtaggcggtttgtcgcgtctgtcgtgaaagcccacggcttaactgtgggtctgcggtggatacgggcagactagaggcaggtaggggagaatggaattcccggtgtagcggtgaaatgcgcagatatcgggaggaacaccggtggcgaaggcggttctctgggcctgtactgacgctgaggagcgaaagcgtggggagcgaacagg

SEQ ID NO: 484 - DNA, 253 bp, Unknown
  Kingdom: Bacteria, Phylum: Proteobacteria, Class: Gammaproteobacteria, Order: Alteromonadales, Family: 211ds20
tacagagggtgcaagcgttaatcggaattactgggcgtaaagcgcgcgtaggcggctaattaagtcgggtgtgaaagccccgggctcaacctgggaattgcatccgatactgattggctagagtatgagagagggaggtagaattccacgtgtagcggtgaaatgcgtagatatgtggaggaataccggtggcgaaggcggcctcctggcttaatactgacgctgaggtgcgaaagcgtggggatcaaacagg

SEQ ID NO: 485 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacagagggtgcaagcgttaatcggaattactgggcgtaaagcgcgcgtaggtggttcgttaagttggatgtgaaatccccgggctcaacctgggaactgcattcaaaactgacgagctagagtatggtagagggtggtggaatttcctgtgtagcggtgaaacgcgtagatataggaaggggcaccagtggcgaaggcgaccacctggactgatactgacactgaggtgcgaaagcgtggggagcaaacggg

SEQ ID NO: 486 - DNA, 253 bp, Unknown
  Kingdom: Bacteria, Phylum: Proteobacteria, Class: Betaproteobacteria, Order: Burkholderiales, Family: Comamonadaceae
tacggaggatgcgagcgttaatcggaattactgggcgtaaagcgtgcgcaggcggctttgcaagacagatgtgaaatccccgggcttaacctgggaactgcatttgtgactgcaaggctagagtacggtagagggggatggaattccgcgtgtagcagtgaaatgcgtagatatgcggaggaacaccgatggcgaaggcaatcccctggacctgtactgacgctcacgcacgaaagcgtggggagcaaacagg

SEQ ID NO: 487 - DNA, 253 bp, Unknown
  Kingdom: Bacteria, Phylum: Actinobacteria, Class: Actinobacteria, Order: Actinomycetales, Family: Micrococcaceae, Genus: Micrococcus
tacgtagggtgcgagcgttatccggaattattgggcgtaaagagctcgtaggcggtttgtcgcgtctgtcgtgaaagtccggggcttaaccccggacccgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacagg

SEQ ID NO: 488 - DNA, 253 bp, Unknown
  Kingdom: Bacteria, Phylum: Bacteroidetes, Class: Cytophagia, Order: Cytophagales, Family: Cytophagaceae, Genus: Dyadobacter
tacggagggtgcgagcgttgtccggatttattgggtttaaagggtgcgtaggtggctttttaagtcagtggtgaaatacagccgctcaacggttgaggtgccattgatactgaagagcttgaaacaagtggaggctgccggaatggatggtgtagcggtgaaatgcatagatatcatccagaacaccgattgcgaaggcaggtggctacgtttgatttgacactgaggcacgaaagcatggggagcaaacagg

SEQ ID NO: 489 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggggctagcgttgttcggaattactgggcgtaaagcgcacgtaggcggcttcctaagtcagaggtgaaagcctggagctcaactccagaactgcctttgagactgggtcgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacagg

SEQ ID NO: 490 - DNA, 253 bp, Unknown
  Kingdom: Bacteria, Phylum: Firmicutes, Class: Bacilli, Order: Bacillales, Family:
tacgtaggtggcaagcgttgtccggaattattgggcgtaaagcgcgcgcaggcggcctcctaagtccgatgtgaaagcccacggctcaaccgtggagggtcattggaaactgggggacttgagtgcaggagagaagagtggaattccacgtgtagcggtgaaatgcgtagagatgtggaggaacaccagtggcgaaggcgactctttggcctgtaactgacgctgaggcgcgaaagcgtggggagcaaacagg

SEQ ID NO: 491 - DNA, 253 bp, Unknown
  Kingdom: Bacteria, Phylum: Proteobacteria, Class: Gammaproteobacteria, Order: Xanthomonadales, Family: Xanthomonadaceae, Genus: Stenotrophomonas
tacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctacctggaccaacactgacactgaggcacgaaagcgtggggagcaaacagg

SEQ ID NO: 492 - DNA, 253 bp, Unknown
  Kingdom: Bacteria, Phylum: Verrucomicrobia, Class: Spartobacteria, Order: Chthoniobacterales, Family: Chthoniobacteraceae, Genus: DA101
tacagaggtctcaagcgttgttcggattcattgggcgtaaagggtgcgtaggtggcgccataagtcgggtgtgaaatctcggggcttaactccgaaactgcattcgatactgtggtgcttgaggactggagaggagactggaattcatggtgtagcagtgaaatgcgtagagatcatgaggaagaccagtggcgaaggcgggtctctggacagttcctgacactgaggcacgaaggccaggggagcaaacggg

SEQ ID NO: 493 - DNA, 253 bp, Unknown
  Kingdom: Bacteria, Phylum: Proteobacteria, Class: Alphaproteobacteria, Order: Rhizobiales, Family: Rhizobiaceae, Genus: Agrobacterium
tacgaagggggctagcgttgttcggaattactgggcgtaaagcgcacgtaggcggacatttaagtcagaggtgaaatcccggagctcaacttcggaactgcctttgatactgggtgtcttgagtatggaagaggttagtggaattgcgagtgtagaggtgaaattcgtagatattcgcaggaacaccagtggcgaaggcggctaactggtccataactgacgctgaggtgcgaaagcgtggggagcaaacagg

SEQ ID NO: 494 - DNA, 253 bp, Unknown
  Kingdom: Bacteria, Phylum: Proteobacteria, Class: Betaproteobacteria, Order: Burkholderiales, Family: Oxalobacteraceae, Genus: Janthinobacterium
tacgtagggtgcaagtgttaatcggaattactgggcgtaaagcgtgcgcaggcggctttgtaagtttgtcgtgaaatccccgggctcaacctgggaatggcgatgaagactgcaaggctagaatctggcagaggggggtagaattccacgtgtagtagtgagatgcgtagagatgtggaggaacaccgatggcgaaggcagccccctgggtcaagattgacgctcatgcacgaaagcgtggggagcaaacagg

SEQ ID NO: 495 - DNA, 252 bp, Unknown
  Kingdom: Bacteria, Phylum: Firmicutes, Class: Bacilli, Order: Bacillales, Family: Paenibacillaceae, Genus: Paenibacillus
tacgtagggggcaagcgttgtccggaattattgggcgtaaagcgcgcgcaggcggtcatttaagtctggtgtttaatcccgaagctcaacttcgggtcgcatcggaaactgggtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 496 - DNA, 253 bp, Unknown
  Kingdom: Bacteria, Phylum: Bacteroidetes, Class: Cytophagia, Order: Cytophagales, Family: Cytophagaceae, Genus: Hymenobacter
tacggagggtgcgagcgttgtccggatttattgggtttaaagggtgcgtaggcggctgtttaagtccggggtgaaagcccgttgctcaacaacggaactgccctggatactggacagcttgagtacagacgaggttggcggaatggaccgagtagcggtgaaatgcatagatacggtccagaaccccgattgcgaaggcagctgactaggctgatactgacgctgaggcacgacagcgtggggagcgaacagg

SEQ ID NO: 497 - DNA, 253 bp, Unknown
  Kingdom: Bacteria, Phylum: Firmicutes, Class: Clostridia, Order: Clostridiales, Family: Clostridiaceae, Genus: Thermoanaerobacterium
tacgtagggggcaagcgttgtccggagtgactgggcgtaaagggcgcgtaggcggttatacaagtcaggtgtaaaagataccggctcaaccggtagatagcatctgatactgtataactagagtacaggagaggggagcggaattcctggtgtagcggtgaaatgcgtagagatcaggaagaacaccggtggcgaaggcggctctctggcctgggactgacgctgaggcgcgaaagcgtggggagcgaacagg

SEQ ID NO: 498 - DNA, 253 bp, Bacillus endophyticus
tacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtgggggaacaccagtggcgaaggcggctctctggtctgtaactgacgctgaggcgcgaaagcgtggggagcgaacagg

SEQ ID NO: 499 - DNA, 253 bp, Unknown
  Kingdom: Bacteria, Phylum: Proteobacteria, Class: Betaproteobacteria, Order: Burkholderiales, Family: Comamonadaceae
tacgtagggtgcaagcgttaatcggaattactgggcgtaaagcgtgcgcaggcggtgatgcaagacagaggtgaaatccccgggctcaacctgggaactgcctttgtgactgcatgactagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 500 - DNA, 254 bp, Unknown
  Kingdom: Bacteria, Phylum: Proteobacteria, Class: Alphaproteobacteria, Order: Rhizobiales, Family: Hyphomicrobiaceae, Genus: Rhodoplanes
tacgaagggggctagcgttgctcggaatcactgggcgtaaagcgcacgtaggcgggctcttaagtcggtggtgaaatcctggagctcaactccagaactgcctccgatactgagagtcttcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacagg

SEQ ID NO: 501 - DNA, 253 bp, Unknown
  Kingdom: Bacteria, Phylum: Actinobacteria, Class: Actinobacteria, Order: Actinomycetales, Family: Williamsiaceae, Genus: Williamsia
tacgtagggtgcgagcgttgtccggaattactgggcgtaaagagctcgtaggcggtttgtcgcgtcgttcgtgaaatcttgatgcttaacatcaagcgtgcgggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacagg

SEQ ID NO: 502 - DNA, 253 bp, Unknown
  Kingdom: Bacteria, Phylum: Actinobacteria, Class: Actinobacteria, Order: Actinomycetales, Family:
tacgtagggcgcaagcgttgtccggaattattgggcgtaaagagctcgtaggcggtttgtcgcgtctgctgtggaatcctcaggctcaacctggggcgtgcagtgggtacgggcagactagagtgcggtaggggagactggaattcctggtgtagcggtggaatgcgcagatatcaggaggaacaccggtggcgaaggcgggtctctgggccgttactgacgctgaggagcgaaagcatggggagcgaacagg

SEQ ID NO: 503 - DNA, 253 bp, Unknown
  Kingdom: Bacteria, Phylum: Firmicutes, Class: Bacilli, Order: Lactobacillales, Family: Leuconostocaceae, Genus: Leuconostoc
tacgtatgtcccgagcgttatccggatttattgggcgtaaagcgagcgcagacggttggttaagtctgatgtgaaagcccggagctcaactccggaaaggcattggaaactggttaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacagg

SEQ ID NO: 504 - DNA, 253 bp, Unknown
  Kingdom: Bacteria, Phylum: Proteobacteria, Class: Betaproteobacteria, Order: Burkholderiales, Family: Burkholderiaceae, Genus: Burkholderia
tacgtagggtgcaagcgttaatcggaattactgggcgtaaagcgtgcgcaggcggtccgttaagacagatgtgaaatccccgggcttaacctgggaactgcatttgtgactggcggactcgagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 505 - DNA, 253 bp, Unknown
  Kingdom: Bacteria, Phylum: Proteobacteria, Class: Alphaproteobacteria, Order: Rickettsiales, Family:
gacggagggggctagcgttgttcggaatgactgggcgtaaagggcgcgtaggcggttttttaagtgaggcgtgaaagccctgggcttaacctaggaggtgcgtttcatactggaagacttgagtacgagagaggaaagcggaattcctagtgtagaggtgaaattcgtagatattaggaagaacaccagtggcgaaggcggctttctggctcgtaactgacgctgaggcgcgaaagcgtggggagcaaacagg

SEQ ID NO: 506 - DNA, 250 bp, Pseudomonas umsongensis
tacagagggtgcaagcgttaatcggaattactgggcgtaaagcgcgcgtaggtggtttgttaagttggatgtgaaagccccgggctcaacctgggaactgcattcaaactgacaagctagagtatggtagagggtggtggaatttcctgtgtagcggtgaaatgcgtagatataggaaggaacaccaggcgaaggcgaccacctggactgatactgacactgaagtgcgaaagcgtggggagcaaacagg

SEQ ID NO: 507 - DNA, 253 bp, Unknown
  Kingdom: Bacteria, Phylum: Bacteroidetes, Class: Cytophagia, Order: Cytophagales, Family: Flammeovirgaceae
tacggagggtgcaagcgttgtccggatttattgggtttaaagggtgcgtaggcggctaattaagtcagtggtgaaagcctgtagctcaactatagaactgccattgatactgattagcttgagtatggttgaggtaagcggaatggatggtgtagcggtgaaatgcatagatatcatccagaacaccgatagcgaaggcagcttactgggccgaaactgacgctgaggcacgaaagcatggggatcgaacagg

SEQ ID NO: 508 - DNA, 253 bp, Unknown
  Kingdom: Bacteria, Phylum: Actinobacteria, Class: Actinobacteria, Order: Actinomycetales, Family: Nocardioidaceae
tacgtagggtgcgagcgttatccggaattattgggcgtaaagggctcgtaggcggtttgtcgcgtcgggagtgagaacaccgggcttaactcggtgcttgctttcgatacgggcagactagaggcatgcaggggagaacggaattcctggtgtagcggtgaaatgcgcagatatcaggaggaacaccggtggcgaaggcggttctctgggcatgtcctgacgctgaggagcgaaagtgtggggagcgaacagg

SEQ ID NO: 509 - DNA, 253 bp, Unknown
  Kingdom: Bacteria, Phylum: Bacteroidetes, Class: Cytophagia, Order: Cytophagales, Family: Cytophagaceae, Genus: Dyadobacter
tacggagggtgcgagcgttgtccggatttattgggtttaaagggtgcgtaggtggctaattaagtcagtggtgaaatacagccgctcaacggttgaggtgccattgatactgattagcttgaaataattggaggctgccggaatggatggtgtagcggtgaaatgcatagatatcatccagaacaccgattgcgaaggcaggtggctacgatttatttgacactgaggcacgaaagcatggggagcaaacagg

SEQ ID NO: 510 - DNA, 253 bp, Sphingomonas wittichii
tacggagggggctagcgttgttcggaattactgggcgtaaagcgcacgtaggcggttttgcaagtcagaggtgaaagcccggagctcaactccggaattgcctttgagactgcgtcacttgaacgtcggagaggtgagtggaattccgagtgtagaggtgaaattcgtagatattcggaagaacaccagtggcgaaggcggctcactggacgactgctgacgctgaggtgcgaaagcgtggggagcaaacagg

SEQ ID NO: 511 - DNA, 253 bp, Unknown
  Kingdom: Bacteria, Phylum: Proteobacteria, Class: Alphaproteobacteria, Order: Rhodobacterales, Family: Rhodobacteraceae, Genus: Paracoccus
tacggagggggctagcgttgttcggaattactgggcgtaaagcgcacgtaggcggaccggacagtcagaggtgaaatcccagggctcaaccttggaactgcctttgaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 512 - DNA, 252 bp, Unknown
  Kingdom: Bacteria, Phylum: Firmicutes, Class: Clostridia, Order: Clostridiales, Family: Tissierellaceae, Genus: Finegoldia
tacgtatggagcgagcgttgtccggaattattgggcgtaaagggtacgcaggcggtttaataagtcgaatgttaaagatcggggctcaaccccgtaaagcattggaaactgataaacttgagtagtggagaggaaagtggaattcctagtgtagtggtgaaatacgtagatattaggaggaataccagtagcgaaggcgactttctggacacaaactgacgctgaggtacgaaagcgtggggagcaaacagg

SEQ ID NO: 513 - DNA, 253 bp, Unknown
  Kingdom: Bacteria, Phylum: Bacteroidetes, Class: Sphingobacteriia, Order: Sphingobacteriales, Family: Sphingobacteriaceae, Genus: Pedobacter
tacggaggatccaagcgttatccggatttattgggtttaaagggtgcgtaggcggcctgttaagtcagaggtgaaagacggtagctcaactatcgcagtgcctttgatactgacgggcttgaataaactagaggtaggcggaatgagacaagtagcggtggaatgcatagatatgtctcagaacaccgattgcggaggcagcttactatggttttattgacgctgaggcacgaaagcgtggggatcaaacagg

SEQ ID NO: 514 - DNA, 253 bp, Pseudomonas viridiflava
gacggggggggcaagtgttaatcggaattactgggcgtaaagcgcgcgtaggtggtttgttaagttgaatgtgaaatccccgggctcaacctgggaactgcatccataactggcaagctagagtagggcagggggtggtggaatttcctgtgtagcggtgaaatgcgtagatataggaaggaacaccagtggcgaaggcgaccacctgggctcatactgacactggggtgcgaaagcgtggggagcaaacagg

SEQ ID NO: 515 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggggctagcgttgttcggaattactgggcgtaaagcgcacgtaggcggctttgtaagttaggggtgaaagcctggagctcaactccagaattgcctttaagactgcatcgcttgaatccaggagaggtgagtggaattccgagtgtagaggtgaaattcgtagatattcggaagaacaccagtggcgaaggcggctgactggacatgtattgacgctgaggtgcgaaagcgtggggagcaaacagg

SEQ ID NO: 516 - DNA, 254 bp, Unknown
  Kingdom: Bacteria, Phylum: Actinobacteria, Class: Actinobacteria, Order: Actinomycetales, Family: Pseudonocardiaceae, Genus: Actinomycetospora
tacgtagggtgcgagcgttgtccggaattattgggcgtaaagagctcgtaggcggtgtgtcgcgtcggccgtgaaaacctggggctcaactctgggcgtgcggtcgatacgggcatcacttgagttcggcaggggagactggaattcctggtgtagcggtgaaatgcgcagatatcaggaggaacaccggtggcgaaggcgggtctctgggccgatactgacgctgaggagcgaaagcatgggtagcgaacagg

SEQ ID NO: 517 - DNA, 253 bp, Unknown
  Kingdom: Bacteria, Phylum: Actinobacteria, Class: Actinobacteria, Order: Actinomycetales, Family: Microbacteriaceae
tacgtagggtgcaagcgttgtccggaattattgggcgtaaagggctcgtaggcggtttgtcgcgtctgctgtgaaatcccgaggctcaacctcgggtctgcagtgggtacgggcagactagagtgtggtaggggagattggaattcctggtgtagcggtggaatgcgcagatatcagggggaacaccgatggcgaaggcagatctctgggccattactgacgctgaggagcgaaagcatggggagcgaacagg

SEQ ID NO: 518 - DNA, 253 bp, Erwinia oleae
tacggagggtgcgagcgttaatcggaattactgggcgtaaagggcacgcaggcggtgtgttaagtcagatgtgaaatccccgggctcaacccgggaactgcatttgaaactggcaggcttgagtctcgtagaggggggtggaattccaggtgtagcggtgaaatgcgtagagatctggaggaataccggtggcgaaggcggccccctggacgaagactgacgctcaggtgcgaaagcgtggggagcaaacagg

SEQ ID NO: 519 - DNA, 253 bp, Unknown
  Kingdom: Bacteria, Phylum: Proteobacteria, Class: Gammaproteobacteria, Order: Pseudomonadales, Family: Pseudomonadaceae
tacgaagggtgcgagcgttaatcggaattactgggcgtaaagcgcgcgtaggtggtttgttaagttggaagtgaaagccccgggctcaacctgggaattgctttcaaaactgacgggctagagtacggtagagggtagtggaatttcctgtgtagcggtgaaatgcgtagatataggaaggaacatcagtggcgaaggcgactacctggactgatactgacactgaggtgcgaaagcgtggggagcaaacagg

SEQ ID NO: 520 - DNA, 253 bp, Unknown
  Kingdom: Bacteria, Phylum: Proteobacteria, Class: Alphaproteobacteria, Order: Rhizobiales, Family: Hyphomicrobiaceae, Genus: Devosia
tacgaagggggctagcgttgttcggatttactgggcgtaaagcgcacgtaggcggattgttaagtgagaggtgaaatcccggagctcaactccggaactgcctttcatactggcaatctagagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 521 - DNA, 253 bp, Unknown
  Kingdom: Bacteria, Phylum: Proteobacteria, Class: Alphaproteobacteria, Order: Sphingomonadales, Family: Sphingomonadaceae, Genus: Kaistobacter
tacggagggggctagcgttgttcggaattactgggcgtaaagcgcacgtaggcggctttgtaagttagaggtgaaagcccggagctcaactccggaattgcctttaagactgcatcgctcgaatcatggagaggtgagtggaattccgagtgtagaggtgaaattcgtagatattcggaagaacaccagtggcgaaggcgactcactggacatgtattgacgctgaggtgcgaaagcgtggggagcaaacagg

SEQ ID NO: 522 - DNA, 253 bp, Bosea genosp.
tacgaagggggctagcgttgctcggaatcactgggcgtaaagggtgcgtaggcgggtttttaagtcagaggtgaaatcctggagctcaactccagaactgcctttgatactgggaatcttgagtatggaagaggtgagtggaactgcgagtgtagaggtgaaattcgtagatattcgcaagaacaccagtggcgaaggcggctcactggtccataactgacgctgaggcacgaaagcgtggggagcaaacagg

SEQ ID NO: 523 - DNA, 253 bp, Unknown
  Kingdom: Bacteria, Phylum: Actinobacteria, Class: Actinobacteria, Order: Actinomycetales, Family: Microbacteriaceae
tacgtagggtgcaagcgttgtccggaattattgggcgtaaagagctcgtaggcggtttgtcgcgtctgctgtgaaaactggaggctcaacctccagcctgcagtgggtacgggcagactagagtgcggcaggggagataggaattcctggtgtagcggtggagtgcgcagatatcaggaggaacaccgatggcgaaggcagatctctgggccgtaactggcgctgaggagcgaaagcgtggggagcgaacagg

SEQ ID NO: 524 - DNA, 253 bp, Unknown
  Kingdom: Bacteria, Phylum: Actinobacteria, Class: Actinobacteria, Order: Actinomycetales, Family: Promicromonosporaceae, Genus: Cellulosimicrobium
tacgtagggcgcaagcgttgtccggaattattgggcgtaaagagctcgtaggcggtctgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacagg

SEQ ID NO: 525 - DNA, 253 bp, Unknown
  Kingdom: Bacteria, Phylum: Proteobacteria, Class: Alphaproteobacteria, Order: Rhodospirillales, Family: Rhodospirillaceae, Genus: Skermanella
tacgaagggggctagcgttgttcggaattactgggcgtaaagggcgcgtaggcggtacttcaagtcaggcgtgaaagccccgggctcaacctgggaaccgcgcttgagactggagaactagagttcgggagaggatggtggaattcccagtgtagaggtgaaattcgtagatattgggaagaacaccgatggcgaaggcagccatctggaccgacactgacgctgaggcgcgaaagcgtggggagcaaacagg

SEQ ID NO: 526 - DNA, 253 bp, Unknown
  Kingdom: Bacteria, Phylum: Proteobacteria, Class: Deltaproteobacteria, Order: Myxococcales, Family:
gacagagggtgcaaacgttgttcggaattactgggcgtaaagcgcgtgtaggcggcagggcatgtcggatgtgaaagcccgtggctcaaccacggaagtgcacccgaaactgcccagcttgagtctcggagaggaaggcggaatgcttggtgtagaggtgaaattcgtagatatcaagcggaacaccggtggcgaaggcggccttctggacgatgactgacgctgagacgcgaaagcgtggggagcaaacagg

SEQ ID NO: 527 - DNA, 253 bp, Unknown
  Kingdom: Bacteria, Phylum: Actinobacteria, Class: Actinobacteria, Order: Actinomycetales, Family: Micrococcaceae, Genus: Arthrobacter
tacgtagggcgcaagcgttatccggatttattgggcgtaaagagctcgtaggcggtttgtcgcgtctatcgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgagagcatggggagcgaacagg

SEQ ID NO: 528 - DNA, 253 bp, Unknown
  Kingdom: Bacteria, Phylum: Proteobacteria, Class: Betaproteobacteria, Order: Burkholderiales, Family: Burkholderiaceae, Genus: Burkholderia
tacgtagggtgcgagcgttaattggaattactgggcgtaaagcgtgcgcaggcggtctgttaagaccgatgtgaaatccccgggcttaacctgggaactgcattggtgactggcaggctagagtgtggcagagggaggtagaattccacgtgtagcagtgaaatgcgtagagatgtggaggaataccgatggcgaaggcagcctcctgggccaacactgacgctcatgcacgaaagcgtggggagcaaacagg

SEQ ID NO: 529 - DNA, 253 bp, Unknown
  Kingdom: Bacteria, Phylum: Firmicutes, Class: Bacilli, Order: Lactobacillales, Family: Carnobacteriaceae, Genus: Carnobacterium
tacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacagg

SEQ ID NO: 530 - DNA, 253 bp, Sphingomonas wittichii
tacggagggggctagcgttgttcggaattactgggcgtaaagcgtacgtaggcggctttgtaagttagaggtgaaagcccggggctcaaccccggaattgcctttaagactgcatcgcttgaatcgcggagaggtgagtggaattccgagtgtagaggtgaaattcgtagatattcggaagaacaccagtggcgaaggcggctcactggacgcgtattgacgctgaggtacgaaagcgtggggagcaaacagg

SEQ ID NO: 531 - DNA, 253 bp, Unknown
  Kingdom: Bacteria, Phylum: Bacteroidetes, Class: Cytophagia, Order: Cytophagales, Family: Cytophagaceae, Genus: Hymenobacter
tacggagggtgcaagcgttgtccggatttattgggtttaaagggtgcgtaggtggcctggtaagtccgtggtgaaagcctcttgctcaacaagagaactgccatggatactgccgggcttgagtccagacgaggttggcggaatagaggctgtagcggtgaaatgcatagatagcctctagaaccccgattgcgtaggcagctgactaggctggtactgacactgaggcacgaaagcgtggggagcgaacagg

SEQ ID NO: 532 - DNA, 253 bp, Streptomyces mirabilis
tacgtaggtggcaagcgttatccggaattattgggcgtaaagagctcgtaggcggctagtcacgtcgggtgtgaaagaccggggcttaaccccggttctgcattcgatacgggctggctagagtgtggtaggggagatcggaattcctggtgtagcggtgaaatgcgcagatatcaggatgaacaccggtggcgaaggcggatctctgggccattactgacgctgaggagcgaaagcgtggggagcgaacagg

SEQ ID NO: 533 - DNA, 253 bp, Unknown
  Kingdom: Bacteria, Phylum: Bacteroidetes, Class: Cytophagia, Order: Cytophagales, Family: Cytophagaceae, Genus: Hymenobacter
tacggagggtgcaagcgttgtccggatttattgggtttaaagggtgcgtaggcggtctggtaagtctggggtgaaagcccgttgctcaacaacggaactgccctggaaactgccagacttgagtacagacgagggtggcggaatggatgctgtagcggtgaaatgcatagatagcatccagaaccccgattgcgaaggcagctgcctagactgtaactgacgctgaggcacgaaagcgtggggagcgaacagg

SEQ ID NO: 534 - DNA, 253 bp, Unknown
  Kingdom: Bacteria, Phylum: Proteobacteria, Class: Gammaproteobacteria, Order: Pseudomonadales, Family: Pseudomonadaceae, Genus: Pseudomonas
tacagagggtgcaagcgttaatcggaattactgggcgtaaagcgcgcgtaggtggttcgttaagttgcatgtggaagccccgggctcaacctgggaactgcattcaaaactgacgagctagagtatggtagagggtggtggaattccctgtgtagcggtgaaatgcgtagatataggaaggaacaccagtggcgaaggcgaccacctggactgatactgacactgaggtgcgaaagcgtggggagcaaacagg

SEQ ID NO: 535 - DNA, 253 bp, Unknown
  Kingdom: Bacteria, Phylum: Proteobacteria, Class: Betaproteobacteria, Order: Methylophilales, Family: Methylophilaceae
tacgtagggtgcgagcgttaatcggaattactgggcgtaaagcgtgcgcaggcggttcgacaagtctgatgtgaaatccccgggctcaacctgggaactgcgttggaaactgtcgggctagagtgtagaagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 536 - DNA, 253 bp, Unknown
  Kingdom: Bacteria, Phylum: Proteobacteria, Class: Gammaproteobacteria, Order: Pseudomonadales, Family: Moraxellaceae, Genus: Alkanindiges
tacagagggtgcgagcgttaatcggaattactgggcgtaaagcgcgcgtaggcggcttgttaagtcggatgtgaaatccctgggctcaacctaggcattgcattcgatactggcaagctagagtatgggagaggaaggtagaattccaggtgtagcggtgaaatgcgtagagatctggtggaataccgatggcgaaggcagccttctggcctaatactgacgctgaggtgcgaaagcatggggagcaaacagg

SEQ ID NO: 537 - DNA, 253 bp, Unknown
  Kingdom: Bacteria, Phylum: Verrucomicrobia, Class: Spartobacteria, Order: Chthoniobacterales, Family: Chthoniobacteraceae, Genus: DA101
tacagaggtctcaagcgttgttcggattcattgggcgtaaagggtgcgtaggcggcgcggtaagtcgggtgtgaaatctcggagcttaactccgaaactgcattcgatactgccgtgcttgaggactggagaggagactggaatttacggtgtagcggtgaaatgcgtagatatcgtaaggaagaccagtggcgaaggcgggtctctggacagttcctgacgctgaggcacgaaggtcaggggagcaaacggg

SEQ ID NO: 538 - DNA, 253 bp, Flavobacterium succinicans
tacggaggatccaagcgttatccggaatcattgggtttaaagggtccgtaggcggtttagtaagtcagtggtgaaagcccatcgctcaacggtggaacggccattgatactgctgaacttgaattactaggaagtaactagaatatgtagtgtagcggtgaaatgcttagatattacatggaataccaattgcgaaggcaggttactactaacggattgacgctgatggacgaaagcgtggggagcgaacagg

SEQ ID NO: 539 - DNA, 253 bp, Unknown
  Kingdom: Bacteria, Phylum: Proteobacteria, Class: Betaproteobacteria, Order: Burkholderiales, Family: Comamonadaceae
tacgtagggtgcgagcgttaatcggaattactgggcgtaaagcgtgcgcaggtggttatgtaagacagatgtgaaatccccgggctcagcctgggaactgcatttgtgactgcatggctagagtacggtagagggggatggaattccgcgtgtagcagtgaaatgcgtagatatgcggaggaacaccgatggcgaaggcaatccccttgacctgtactgacgctcatgcacgaaagcgtggggagcaaacagg

SEQ ID NO: 540 - DNA, 253 bp, Unknown
  Kingdom: Bacteria, Phylum: Proteobacteria, Class: Alphaproteobacteria, Order: Rhodospirillales, Family: Acetobacteraceae
tacgaagggggctagcgttgctcggaattactgggcgtaaagggcgcgtaggcggcttagttagtcaggcgtgaaattcctgggctcaacctggggactgcgcttgatacggctaggctagaggatggaagagggtcgcggaattcccagtgtagaggtgaaattcgtagatattgggaagaacaccggtggcgaaggcggcgacctggtccattactgacgctgaggcgcgacagcgtggggagcaaacagg

SEQ ID NO: 541 - DNA, 253 bp, Unknown
  Kingdom: Bacteria, Phylum: Actinobacteria, Class: Actinobacteria, Order: Actinomycetales, Family: Nocardioidaceae
tacgtagggtccgagcgttgtccggaattattgggcgtaaagggctcgtaggcggtttgtcgcgtcgggagtgaaaacctcatgcttaacatgtggcttgcttccgatacgggcagactagaggtatgcaggggagaatggaattcctggtgtagcggtgaaatgcgcagatatcaggaggaacaccggtggcgaaggcggttctctgggcattacctgacgctgaggagcgaaagtgtggggagcgaacagg

SEQ ID NO: 542 - DNA, 252 bp, Unknown
  Kingdom: Bacteria, Phylum: Proteobacteria, Class: Betaproteobacteria, Order: Burkholderiales, Family: Oxalobacteraceae, Genus: Janthinobacterium
gacagaggatgcaagcgttatcggaattactgggcgtaaagcgtgcgcaggcggttttgtaagtctgtcgtgaaatccccgggctcaacctgggaattgcgatggagactgcaaggctagaatctggcagaggggggtagagttccacgtgtagcagtgaaatgcgtagagatgtggaggaacaccgatggcgaaggcagccccctgggtcaagattgacgctcatgcacgaaagcgtggggagcaaacagg

SEQ ID NO: 543 - DNA, 253 bp, Unknown
  Kingdom: Bacteria, Phylum: Actinobacteria, Class: Actinobacteria, Order: Actinomycetales, Family: Kineosporiaceae
tacgtagggtgcaagcgttgtccggaattattgggcgtaaagagctcgtaggcggtttgtcgcgtctgctgtgaaaactcagggcttaaccctgagcttgcagtgggtacgggcagactagagtgcagtaggggagactggaattcctggtgtagcggtgaaatgcgcagatatcaggaggaacaccggtggcgaaggcgggtctctgggctgtaactgacgctgaggagcgaaagcgtggggagcgaacagg

SEQ ID NO: 544 - DNA, 253 bp, Unknown
  Kingdom: Bacteria, Phylum: Proteobacteria, Class: Betaproteobacteria, Order: Burkholderiales, Family: Oxalobacteraceae
tacgtagggtgcaagcgttaatcggaattactgggcgtaaagcgtgcgcaggcggttttgtaagtctgtcgtgaaatccccgggctcaacctgggaattgcgatggagactgcaaggctagaatatgtcagaggggggtagaattccacgtgtagcagtgaaatgcgtagagatgtggagggataccaatggcgaaggcagccccctgggtcaagactgacgctcatgcacgaaagcgtggggagcaaacagg

SEQ ID NO: 545 - DNA, 253 bp, Unknown
  Kingdom: Bacteria, Phylum: Verrucomicrobia, Class: Opitutae, Order: Opitutales, Family: Opitutaceae, Genus: Opitutus
tacagagattgcaagcgttattcggattcactgggcgtaaagggtgcgcaggcggccatgtgtgtcaggtgtgaaagcccgaggctcaacctcggaattgcgcctgaaactacatggctagagtactggagagggtagcggaattcatggtgtagcagtgaaatgcgtagatatcatgaggaacaccagaggcgaaggcggctacctggacagttactgacgctcaggcacgaaagcgtggggagcaaaaggg

SEQ ID NO: 546 - DNA, 253 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggagctagcgttgttcggaattactgggcgtaaagcgcgcgtaggcggctttgtaagttaggggtgaaagcccggagctcaactccggaattgcctttaagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacagg

SEQ ID NO: 547 - DNA, 1436 bp, Unknown
  Kingdom: Bacteria, Phylum: Firmicutes, Class: Bacilli, Order: Bacillales, Family: Paenibacillaceae, Genus: Paenibacillus
atacatgcagtcgagcggacttgcatgagaagcttgcttctctgatggttagcggcggacgggtgagtaacacgtaggcacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaagcgcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggttttattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgatc

SEQ ID NO: 548 - DNA, 938 bp, Unknown
  Kingdom: Bacteria, Phylum: Proteobacteria, Class: Gammaproteobacteria, Order: Enterobacteriales, Family: Enterobacteriaceae, Genus: Pantoea
cagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggaggg

SEQ ID NO: 549 - DNA, 1333 bp, Unknown; identical to SEQ ID NO: 9
  Kingdom: Bacteria, Phylum: Proteobacteria, Class: Gammaproteobacteria, Order: Xanthomonadales, Family: Xanthomonadaceae, Genus: Luteibacter

SEQ ID NO: 550 - DNA, 1375 bp, Unknown
  Kingdom: Bacteria, Phylum: Actinobacteria, Class: Actinobacteria, Order: Actinomycetales, Family: Streptomycetaceae, Genus: Streptomyces
gggttgggccaccggcttcgggtgttaccgactttcgtgacgtgacgggcggtgtgtacaaggcccgggaacgtattcaccgcagcactgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccgagttgaccccggcggtctcctgtgagtccccatcaccccgaagggcatgctggcaacacagaacaagggttgcgctcgttgcgggacttaacccaacatctcacgacacgagctgacgacagccatgcaccacctgtacaccgaccacaagggggcacccatctctggatgtttccggtgtatgtcaagccttggtaaggttcttcgcgttgcgtcgaattaagccacatgctccgccgcttgtgcgggcccccgtcaattcctttgagttttagccttgcggccgtactccccaggcggggaacttaatgcgttagctgcggcaccgacgacgtggaatgtcgccaacacctagttcccaccgtttacggcgtggactaccagggtatctaatcctgttcgctccccacgctttcgctcctcagcgtcagtaatggcccagagatccgccttcgccaccggtgttcctcctgatatctgcgcatttcaccgctacaccaggaattccgatctcccctaccacactctagcctgcccgtatcgactgcagacccgaggttaagcctcgggctttcacaatcgacgtgacaagccgcctacgagctctttacgcccaataattccggacaacgcttgcgccctacgtattaccgcggctgctggcacgtagttagccggcgcttcttctgcaggtaccgtcacttgcgcttcttccctgctgaaagaggtttacaacccgaaggccgtcatccctcacgcggcgtcgctgcatcaggcttgcgcccattgtgcaatattccccactgctgcctcccgtaggagtctgggccgtgttcagtcccagtgtggccggtcgccctctcaggccggctacccgtcgtcgccttggtgagccattacctcaccaacaagctgataggccgcgggctcatccttcaccgccggagctttccacgcacatcggatgcccgagcgcgtcgtatccggtattagaccccgtttccagggcttgtcccagagtgaagggcagattgcccacgtgttactcacccgttcgccactaatccaccccgaagggcttcatcgttcgactgca

SEQ ID NO: 551 - DNA, 880 bp, Unknown
  Kingdom: Bacteria, Phylum: Actinobacteria, Class: Actinobacteria, Order: Actinomycetales, Family: Streptomycetaceae, Genus: Streptomyces
cgctggaccaactccttcgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggcgtacaggtcgtgcatggctgtcgtcagctcgtgtcgtgagatgttgggtaagtcccgcaacgagcgcaaccttgttctggtgctgccagcatgcccttcgggtgatgggacttcaccacggagaccgcggctccactccgacgaggtgggggacgacgtcagtcatcatgccctaatgtctggctg

SEQ ID NO: 552 - DNA, 873 bp, Unknown
  Kingdom: Bacteria, Phylum: Actinobacteria, Class: Actinobacteria, Order: Actinomycetales, Family: Streptomycetaceae, Genus: Streptomyces
ccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtct

SEQ ID NO: 553 - DNA, 1375 bp, Unknown; identical to SEQ ID NO: 550
  Kingdom: Bacteria, Phylum: Actinobacteria, Class: Actinobacteria, Order: Actinomycetales, Family: Streptomycetaceae, Genus: Streptomyces

SEQ ID NO: 554 - DNA, 1160 bp, Unknown
  Kingdom: Bacteria, Phylum: Actinobacteria, Class: Actinobacteria, Order: Actinomycetales, Family: Streptomycetaceae, Genus: Streptomyces
ccgggggcactccactgcgtatgtgtgacgagtagaccgctgcgcttagctgaggtctgatgaaatgtagaacacttaacaaaaatatgcccggatggatatacttttcaacgacagggctgcgattggatgatctcctttgaaacacagaactagtcacggcgacgaatactcaacttcgaccccccccctttctggaggcgcgtcttagtcccctccttgatggagctgccccgtgctcggcggccggagtcggcggtgttttccgctgtacctgagacgctggaccaactccttcgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggcgtacaggtcgtgcatggctgtcgtcagctcgtgtcgtgagatgttgggtaagtcccgcaacgagcgcaaccttgttctggtgctgccagcatgcccttcgggtgatgggacttcaccacggagaccgcggctccactccgacgaggtgggggacgacgtcagtcatcatgccctaatgtctggctg

SEQ ID NO: 555 - DNA, 1160 bp, Unknown; identical to SEQ ID NO: 554
  Kingdom: Bacteria, Phylum: Actinobacteria, Class: Actinobacteria, Order: Actinomycetales, Family: Streptomycetaceae, Genus: Streptomyces

SEQ ID NO: 556 - DNA, 1382 bp, Unknown
  Kingdom: Bacteria, Phylum: Actinobacteria, Class: Actinobacteria, Order: Actinomycetales, Family: Streptomycetaceae, Genus: Streptomyces
cacatgcagtcgaacgatgaagcctttcggggtggattagtggcgaacgggtgagtaacacgtgggcaatctgcccttcactctgggacaagccctggaaacggggtctaataccggataatacttctgcctgcatgggtgggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccct

SEQ ID NO: 557 - DNA, 1160 bp, Unknown; identical to SEQ ID NO: 554
  Kingdom: Bacteria, Phylum: Actinobacteria, Class: Actinobacteria, Order: Actinomycetales, Family: Streptomycetaceae, Genus: Streptomyces

SEQ ID NO: 558 - DNA, 1403 bp, Unknown
  Kingdom: Bacteria, Phylum: Actinobacteria, Class: Actinobacteria, Order: Actinomycetales, Family: Streptomycetaceae, Genus: Streptomyces
taccatgcagtcgaacgatgaagcccttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttggggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcga

SEQ ID NO: 559 - DNA, 1407 bp, Unknown
  Kingdom: Bacteria, Phylum: Actinobacteria, Class: Actinobacteria, Order: Actinomycetales, Family: Streptomycetaceae, Genus: Streptomyces
acatgcaagtcgaacgatgaagcccttcggggtggattagtggcgaacgggtgagtaacacgtgggcaatctgccctgcactctgggacaagccctggaaacggggtctaataccggatatgaccatcttgggcatccttgatggtgtaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaaattattgggcgtaaagagctcgtaggcggcttgtcacgtcgattgtgaaagctcggggcttaaccccgagtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccggtacgagcgcaacccttgtccggtgttgccagcaggcccttgtggagctggggactcacggggagacccgcggggggtcaactcggaagggcatggaggggacgacgttcaagtcatcatgccccatttcacttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcga

SEQ ID NO: 560 - DNA, 880 bp, Unknown; identical to SEQ ID NO: 551
  Kingdom: Bacteria, Phylum: Actinobacteria, Class: Actinobacteria, Order: Actinomycetales, Family: Streptomycetaceae, Genus: Streptomyces

SEQ ID NO: 561 - DNA, 505 bp, Pestalotiopsis besseyi
cggagggatcattacagagttatctaactcccaaacccatgtgaacttaccttttgttgcctcggcagtgcctaccctgtagccagttaccctgtaacgaactaccctgtagcgcctgccgatggaccattaaactcttgttatttttaagtaatctgagcgtcttattttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtattgggaatcgactgtattgtcgttcttcaaattcaacggcggatttatagcaatctctgaacgtagtaatctttatctcgtttttgaaatactataaacctcagccgctaaaccccccaattttaatggttgacctcggatcag

SEQ ID NO: 562 - DNA, 1119 bp, Unknown
  Kingdom: Fungi, Phylum: Ascomycota, Class: Eurotiomycetes, Order: Chaetothyriales, Family: Herpotrichiellaceae, Genus: Phaeomoniella
tgagttagggtctcttttagagcccgaatctccaaccctttgttaaaaacactttgttgctttggcaggcccgtcttatcctttaaccgggagacgaccgccgggggcgtttagtcacctctggtccgtgcttgccgatagcctattaaaaattctttattaaattatgtctgaaaaattataactaaatataattaaaacttttaacaacggatctcttggttctggcatcgatgaagaacgcagcgaaatgcgataagtaatgtgaattgcagacttcagtgaatcatcgaatctttgaacgcacattgcgccctttggtattccgaagggcatgcctgttcgagcgtcattatcaaccctcaagcccggcttgttattgggtccttatcgttaaagataggcccgaaagataatggcggcgtcacaaatgaccccagatgcagcgagcttatacagcatacattgaaaggtttttgtggcccggccttaacgagaagcaattctcaattttttacaggttgacctcggatcaggtaggaatacccgctgaacttaagcatatcaataagcggaggaaaagaaaccaacagggattgcctcagtaacggcgagtgaagcggcaatagctcaaatttgaaatctggctcttcgagtccgagttgtaatttgtagaggatgtttcgggtgcgcccgcagtttaagttccttggaacaggacgtcatagagggtgagaatcccgtcttgaactgtacggcaagtccatgtgaaactccttcgacgagtcgagttgtttgggaatgcagctcaaaatgggaggtaaatttcttctaaagctaaatattggccagagaccgatagcgcacaagtagagtgatcgaaagatgaaaagcactttgaaaagagagttaaacagtatgtgaaattgttaaaagggaagcgtttgcaaccagacttgtttctaacagttctaccgcagttctctgtggcttattctgttagtccaggccagcatcagtttgggtggctcgttaaaggccttgggaatgtatctactccttcgggtgtagacttatagccctcggtgtaatagggtctacctggactgaggtacgcgc

SEQ ID NO: 563 - DNA, 1099 bp, Unknown
  Kingdom: Fungi, Phylum: Ascomycota, Class: Sordariomycetes, Order: Sordariomycetes, Family: Xylariomycetidae, Genus: Biscogniauxia
ggaggacattagcgagttatcataaactccaaaacccctgtgaacttacctatgttgcctcggcaggtcgtggtgtgtagcggtgaccactgggtcgcttgcctcgcaccacgctgaaaagacctgtcaaaggacccctaaactctgtttttacaactgtatctctgagtctattatacaaataagttaaaactttcaacaacggatctcttggctctggcatcgatgaagaacgcagcgaaatgcgataagtaatgtgaattgcagaattcagtgaatcatcgaatctttgaacgcacattgcgcctgatagtattctgtcaggcatgcctgttcgagcgtcatttcaacccccaagccctatttgcttgacgttgggagtttacggagacgtaattcctcaaatatagtggcggagctaggtcgtgctctaagcgtagtaaccacaattctcgcttctgcagccggcttaggtcctgccgtaaaacccctatatttttttattggttgacctcggatcaggtaggaatacccgctgaacttaagcatatcaataagcggaggaaaagaaaccaacagggattgccctagtaacggcgagtgaagcggcaacagctcaaatttgaaatctggccctcgggtccgagttgtaatttgcagaggatgcttttggcgcggtgccttccgagttccctggaacgggacgccttagagggtgagagccccgtacggttggacaccaagcctctgtaaagctccttcgacgagtcgagtagtttgggaatgctgctctaaatgggaggtaaatttcttctaaagctaaataccggccagagaccgatagcgcacaagtagagtgatcgaaagatgaaaagcactttgaaaagagggttaaatagcacgtgaaattgttgaaagggaagcgtttacggccagaccttttcctggcggatcatctggtgttctcaccagtgcactccgccaggtttaggccagcatcggctcccgtagggggataaaagcagtgggaaagtagctccctcgggagtgttatagcccgctgcacaatacccttacaggggccgaggaccgcgctctg

SEQ ID NO: 564 - DNA, 1120 bp, Unknown
  Kingdom: Fungi, Phylum: Ascomycota, Class: Eurotiomycetes, Order: Chaetothyriales, Family: Herpotrichiellaceae, Genus: Phaeomoniella
tgagttagggtctctttagagcccgaatctccaaccctttgttaaaaacactttgttgctttggcaggcccgtcctatcccttcaccgggagacgaccgccgggggcgtttagtcacctctggtcagtgcttgccgatagcctattaaaaattctttattaaataatgtctgaaaaattataactaaatataattaaaacttttaacaacggatctcttggttctggcatcgatgaagaacgcagcgaaatgcgataagtaatgtgaattgcagacttcagtgaatcatcgaatctttgaacgcacattgcgccctttggtattccgaagggcatgcctgttcgagcgtcattatcaaccctcaagcccggcttgttattgggttcttatcgttaaagataggcccgaaagataatggcggcgtcacaaatgaccccagatgcagcgagcttatacagcatacatcgaaaggtttttgtggcccggccttaacgagaagcaattctcaattttttacaggttgacctcggatcaggtaggaatacccgctgaacttaagcatatcaataagcggaggaaaagaaaccaacagggattgcctcagtaacggcgagtgaagcggcaatagctcaaatttgaaatctggctcttcgagtccgagttgtaatttgtagaggatgtttcgggtgcgcccgcagtttaagttccttggaacaggacgtcatagagggtgagaatcccgtcttgaactgtacggcaagtccatgtgaaactccttcgacgagtcgagttgtttgggaatgcagctcaaaatgggaggtaaatttcttctaaagctaaatattggccagagaccgatagcgcacaagtagagtgatcgaaagatgaaaagcactttgaaaagagagttaaacagtatgtgaaattgttaaaagggaagcgtttgcaaccagacttgtttctaacagttctaccgcagttctctgtggcttattctgttagtccaggccagcatcagtttgggtggctcgttaaaggccttgggaatgtatctactccttcgggtgtagacttatagccctcggtgtaatagggtctacctggactgaggtacgcgctt

SEQ ID NO: 565 - DNA, 1025 bp, Unknown
  Kingdom: Fungi, Phylum: Ascomycota, Class: Sordariomycetes, Order: , Family:
attactgagttatctaaactcccaaccctttgtgaaccttaccgtcgttgcctcggcgggctgtacttaccctgtagctaccctgtagctacccggtaggtgcgctccaagcccgccggtggaccactaaattctattttactactgtatctctgaatgcttcaacttaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctattcgagcgtcatttcaacccttaagcctagttgcttagtgttgggaatctgccctgtatttatagggcagttccttaaagtgatcggcggagttagggcatactctaagcgtagtaatattcttctcgcttctgtagttgtcctggcggcttgccgttaaacccctatatttctagtggttgacctcggattaggtaggaatacccgctgaacttaagcatatcaataagcggaggaaaagaaaccaacagggattgccctagtaacggcgagtgaagcggcaacagctcaaatttgaaatctggccctagcggtccgagttgtaatttgtagaggatgcttttggttaggtgccttctgagttccctggaacgggacgccagagagggtgagagccccgtacggttggacaccgagcctctatatagctccttcgacgagtcgagtagtttgggaatgctgctctaaatgggaggtaaatttcttctaaagctaaataccggccagagaccgatagcgcacaagtagagtgatcgaaagatgaaaagtactttgaaaagagggttaaatagcacgtgaaattgttgaaagggaagcgtttgcgaccagactttttccaggcggatcatcctgtgttctcaccggtgcacttcgcctggtttaggccagcatcggttctcttagggggataaaggcctggggaa

SEQ ID NO: 566 - DNA, 592 bp, Unknown
  Kingdom: Fungi, Phylum: Ascomycota, Class: Eurotiomycetes, Order: Chaetothyriales, Family:
tgcttaagttcagcgggtattcctacctaatccgaggtcaacctttgaatttagttaaattgctttaacgtaaaggggccggaccacaaagaccacctcagtgtatgctataagctcgctgcacctggggtcattcatgacgccgccattatctttcgggcctatctttaacgataagggacccaataacaagccgggcttgagggttgataatgacgctcgaataggcatgcccttcggaataccaaagggcgcaatgtgcgttcaaagattcgatgattcactgaattctgcaattcacattacttatcgcatttcgctgcgttcttcatcgatgccagaaccaagagatccgttgttgaaagttttaattaaattttaattaaagattcagacttcataattataaagaatttagattggctactgacaagcactgaccagaggtgacttaacccctccggcggccccgaaaggcgggcctgccaaagcaacaaagtagttaaacatagggttggaggttcgggcccagaggaccctaactcagtaatgatccttccgcaggttcacctacggaaaccttgttacgact

SEQ ID NO: 567 - DNA, 601 bp, Phoma brasiliensis
  misc_feature (556)..(556): n is a, c, g, or t
  misc_feature (592)..(592): n is a, c, g, or t
aaatcacggttcgtaggtgaacctgcggaaggatcattacctagagttgtaggctttgcctgctatctcttacccatgtcttttgagtaccttcgtttcctcggcgggtccgcccgccgattggacaatttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccctcaagctttgcttggtgttgggtgtttgtctcgcctctgcgcgtagactcgcctcaaaaaaattggcagccggtgtattgatttcggagcgcagtacatctcgcgctttgcactcaaaactgacsacrtccaaaagtacatttttacactcttgacctcggatcaggtagggatacccgctgaacttaagcatatcataggcgagaggaaatcangtaggaatacccgctgaacttaagcatatcaatagncggaggaaa

SEQ ID NO: 568 - DNA, 1007 bp, Unknown
  Kingdom: Fungi, Phylum: Ascomycota, Class: Dothideomycetes, Order: Pleosporales, Family: Pleosporaceae, Genus: Alternaria
  misc_feature (156)..(156): n is a, c, g, or t
agtcgacggcagcgcggggcaacctggcggcgagtggcgaacgggtgagtaatatatcggaacgtacccaaaagtgggggataacgtagcgaaagttacgctaataccgcatacgatctacggatgaaagtgggggaccttcgggccttgtgctcntggagcggccgatatctgattagctagttggtgaggtaaaggctcaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggctgaggctaatatcctcggctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggctcaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctagtaatcgcggatcagcatgtcgcggtgaatacgttcccgggtcttgtacacaccgcccgtcacaccatgggagcgggtttaccagaagtaggagctaacc

SEQ ID NO: 569 - DNA, 592 bp, Unknown
  Kingdom: Fungi, Phylum: Ascomycota, Class: Dothideomycetes, Order: Dothideales, Family: Dothioraceae, Genus: Aureobasidium
tttaatagtcgtagtgactgcggaaggatcattaaagagtaagggtgctcagcgcccgacctccaaccctctgttgttaaaactaccttgttgctttggcgggaccgctcggtctcgagccgctggggattcgtcccaggcgagcgcccgccagagttaaaccaaactcttgttatataaaccggtcgtctgagttaaaattttgaataaatcaaaactttcaacaacggatctcttggttctcgcatcgatgaagaacgcagcgaaatgcgataagtaatgtgaattgcagaattcagtgaatcatcgaatctttgaacgcacattgcgccccttggtattccgaggggcatgcctgttcgagcgtcattacaccactcaagctatgcttggtattgggcgtccgtcccttcgggggcgcgccttaaagacctcggcgaggcctcaccggctttaggcgtagtagaatttattcgaacgtctgtcaatggagaggacttctgccgactgaaaccttttatatttttctaggttgacctcggatcaggtagggatacccgctgaacttaagcatatcaatagccggaggaaa

SEQ ID NO: 570 - DNA, 574 bp, Lecythophora fasciculata
ttcacggttcgtggtgaaccagcggagggatcattacaagaagccgaaaggctacttcaaaccatcgtgaacttatccaagttgcttcggcggcgcggctcccctcgcggggtgccgcagccccgccccctcgggggtggtgggcgcccgccggaggtattaaactctcccgtattatagtggtatttctgagtaaaaacaaataagttaaaactttcaacaacggatctcttggttctggcatcgatgaagaacgcagcgaaatgcgataagtaatgtgaattgcagaattcagtgaatcatcgaatctttgaacgcacattgcgcccgctagtattctagcgggcatgcctgttcgagcgtcatttcaaccctcaagccctgcttggtgttggggccctacggctgccgtaggccctgaaaagaagtggcgggctcgctgcaactccgagcgtagtaattcattatctcgctagggaggcgcggcggtgctcctgccgttaaagaccatctttaaccaaaggttgacctcggatcaggtaggaatacccgctgaacttaagcatatcataaa

SEQ ID NO: 571 - DNA, 662 bp, Unknown
  Kingdom: Fungi, Phylum: Ascomycota, Class: Dothideomycetes, Order: Dothideales, Family: Dothioraceae, Genus: Hormonema
  misc_feature (40)..(40): n is a, c, g, or t
  misc_feature (172)..(172): n is a, c, g, or t
  misc_feature (184)..(184): n is a, c, g, or t
  misc_feature (319)..(319): n is a, c, g, or t
  misc_feature (345)..(345): n is a, c, g, or t
  misc_feature (355)..(355): n is a, c, g, or t
  misc_feature (397)..(398): n is a, c, g, or t
  misc_feature (425)..(425): n is a, c, g, or t
  misc_feature (527)..(527): n is a, c, g, or t
tttaacacggttccgagggacctgcggaaggatcattaangagttgcgtggaaatctcccgcaaacctcaaccctgttgttgttataactaccttgttgctttggcgtggaccgtccggttcgccggactgccagggcccttaggggccgcggtaagcgcccgccagagtcnaaccaaactctngtttttaaccggtcgtctgagtacaagtttaaattaaattaaaactttcaacaaaggatctcttggttctcgcatcgatgaagaacgcagcgaaatgcgataagtaatgtgaattgcagaattcagtgaatcatngaatctttgaacgcacattgcgcccnttggtattcngaggggcatgcctgttcgagcgtcattacaccattcaagctnngcttggtattaggcattcgtcctcctncacggtgggcgggcctcaaaaatctcggcggagcctttccagctttgggcgtagtagaatttctaatcacgtctttaaacggagaggtttccactgccgctnaaccttttatttttcaggttgacctcggatcacgtagggatacccgctgaacttaagcatatcaaaacccggaggaatttatttgggtgacctcagatcaggtagggatacccgctgaacttaagcatatcatag

SEQ ID NO: 572 - DNA, 552 bp, Preussia intermedia
aaaaacacggttcgtaggtgaacctgcggaaggatcattatcgtagggcttcggccctgtcgagatagaacccttgcctttttgagtacctttcgtttcctcggcaggctcgcctgccaatggggaccacaaaaaacactttgcagtacctgtaacagtctgaacaaacaaaacaaaaatcaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctaagcttggtgttgggtgactgtccgcttcactgcggactcgcctcaaaattattggcggccggtacattggcttcgagcgcagcagaaacgcgaactcgggcccgtcgtattggctcccagaagctatcttcacaattttgacctcggatcaggtagggatacccgctgaacttaagcatatcataaccgcggaggaaa

SEQ ID NO: 573 - DNA, 1383 bp, Unknown
  Kingdom: Fungi, Phylum: Ascomycota, Class: Sordariomycetes, Order: Coniochaetales, Family: Coniochaetaceae, Genus: Lecythophora
gcagtcgacggcagcacgggagcaatcctggtggcgagtggcgaacgggtgagtaatacatcggaacgtgcccaatcgtgggggataacgcagcgaaagctgtgctaataccgcatacgatctacggatgaaagcaggggaccgcaaggccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagcaatgccgcgtgcaggatgaaggccttcgggttgtaaactgcttttgtacggaacgaaacggttctttctaataaagagagctaatgacggtaccgtaagaataagcaccggctaactacgtgccagcagccgcggtaatacgtagggtgcaagcgttaatcggaattactgggcgtaaagcgtgcgcaggcggttatgtaagacagttgtgaaatccccgggctcaacctgggaattgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttaccagagatggtttagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagccaacc

SEQ ID NO: 574 - DNA, 533 bp, Unknown
  Kingdom: Fungi, Phylum: Ascomycota, Class: Dothideomycetes, Order: Incertae sedis, Family: Incertae sedis, Genus: Monodictys
aacacggttcgtatgtacctgcggaaggatcattatcgtagggcttcggccctgtcgagatagaacccttgcctttttgagtacctcttgtttcctcggcgggctcgcccgccgatggacccccccaaaaaacactttgcagtacctgtaatagtctgaacaacaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgttgggtgactgtccccctcaaaagggactcgcctcaaaatcattggcggccggtacgttggcttcgagcgcagcagaaacgcgaactcggagactttgtgtcggctcccagaagccatctttaaattttgacctcggatcaggtagggatacccgctgaacttaagcatatcataa

SEQ ID NO: 575 - DNA, 598 bp, Pestalotiopsis rhododendri
ccacacggtccgtggtgacagcggagggatcattatagagttttttaaactcccaacccatgtgaacttaccattgttgcctcggcagaagctacctggttaccttaccttggaacggcctaccctgtagcgccttaccctggaacggcctaccctgtaacggctgccggtggactaccaaactcttgttattttattgtaatctgagcgtcttattttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtgttgggagcctactgcttttgctagcggtagctcctgaaatacaacggcggatctgcgatatcctctgagcgtagtaatttttatctcgcttttgactggagttgcagcgtctttagccgctaaaccccccaatttttaatggttgacctcggatcaggtaggaatacccgctgaacttaagcatatcta

SEQ ID NO: 576 - DNA, 542 bp, Cladosporium colocasiae
aataaacagttcgtagtgaccgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcgatcaggtagggatacccgctgaacttaagcatat

SEQ ID NO: 577 - DNA, 578 bp, Botryosphaeria corticis
aacacggttcgtagggacctgcggaaggatcattaccgagttgattcgggctccggcccgatcctcccaccctttgtgtacctacctctgttgctttggcgggccgcggtcctccgcggccgcccccctccccggggggtggccagcgcccgccagaggaccatcaaactccagtcagtaaacgatgcagtctgaaaaacatttaataaactaaaactttcaacaacggatctcttggttctggcatcgatgaagaacgcagcgaaatgcgataagtaatgtgaattgcagaattcagtgaatcatcgaatctttgaacgcacattgcgccctttggtattccgaagggcatgcctgttcgagcgtcattacaaccctcaagctctgcttggtattgggcaccgtcctttgcgggcgcgcctcaaagacctcggcggtggcgtcttgcctcaagcgtagtagaacatacatctcgcttcggagcgcagggcgtcgcccgccggacgaaccttctgaacttttctcaaggttgacctcggatcaggtagggatacccgctgaacttaagcatatcatag

SEQ ID NO: 578 - DNA, 645 bp, Phyllosticta ericarum
aacacggttcgtagtgacctgcggaaggatcattactgaaaatgtaataaacccttcaggttttggaagggggagccgtcaaaagcttccctggtacatgcctcaccccttgtatatctaccatgttgctttggcgggccgacccggtttcgacccgggcggccggcgcccccagcctgcttgccaggccaggacgcccggccaagtgcccgccagtatacaaaactccagcgattattttgtgtagtcctgagaatttattcaataaattaaaactttcaacaacggatctcttggttctggcatcgatgaagaacgcagcgaaatgcgataagtaatgtgaattgcagaattcagtgaatcatcgaatctttgaacgcacattgcgccctctggcattccggagggcatgcctgttcgagcgtcatttcaaccctcaagctctgcttggtattgggcgacgtctgctgtcagacgcgcctggaagacctcggcgacggcattccagcctcgagcgtagtagtaaaatatctcgctttggaggatggggtgacggcttgccggacaaccgacctctggtcattttttccaaggttgacctcggatcaggtagggatacccgctgaacttaagcatatataggcg

SEQ ID NO: 579 - DNA, 600 bp, Paraconiothyrium variabile
aaacacggttcgtagtgacctgcggaaggatcattatctattccatgaggtgcggtcgcggccctcggcgggagcaacagctaccgtcgggcggtagaggtaacactttcacgcgccgcatgtctgaatcctttttttacgagcacctttcgttctccttcggcggggcaacctgccgttggaacctatcaaaacctttttttgcatctagcattacctgttctgatacaaacaatcgttacaactttcaacaatggatctcttggctctggcatcgatgaagaacgcagcgaaatgcgataagtagtgtgaattgcagaattcagtgaatcatcgaatctttgaacgcacattgcgccccttggtattccatggggcatgcctgttcgagcgtcatctacaccctcaagctctgcttggtgttgggcgtctgtcccgcctctgcgcgcggactcgccccaaattcattggcagcggtccttgcctcctctcgcgcagcacattgcgcttctcgaggtgcgcggcccgcgtccacgaagcaacattaccgtctttgacctcggatcaggtagggatacccgctgaacttaagcatatctg

SEQ ID NO: 580 - DNA, 615 bp, Pestalotiopsis rhododendri
aaaacacggtctgttgtgaaccagcggagggatcattatagagttttctaaactcccaacccatgtgaacttaccattgttgcctcggcagaagctacctggttaccttaccttggaacggcctaccctgtagcgccttaccctggaacggcctaccctgtaacggctgccggtggactaccaaactcttgttattatattgtaatctgagcgtcttattttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtgttgggagcctactgcttttgctagcggtagctcctgaaatacaacggcggatctgcgatatcctctgagcgtagtaatttttatctcgcttttgactggagttgcagcgtctttagccgctaaaccccccaatttttaatggttgacctcggatcaggtaggaatacccgctgaacttaagcatatcataggccgaaaggaaa

SEQ ID NO: 581 - DNA, 604 bp, Paraconiothyrium brasiliense
ttacacggttcgtaggtgaacctgcggaaggatcattatctattccatgaggtgcggtcgcggccctcggcgggagcaacagctaccgtcgggcggtagaggtaacactttcacgcgccgcatgtctgaatcctttttttacgagcacctttcgttctccttcggcggggcaacctgccgttggaacctatcaaaacctttttttgcatctagcattacctgttctgatacaaacaatcgttacaactttcaacaatggatctcttggctctggcatcgatgaagaacgcagcgaaatgcgataagtagtgtgaattgcagaattcagtgaatcatcgaatctttgaacgcacattgcgccccttggtattccatggggcatgcctgttcgagcgtcatctacaccctcaagctctgcttggtgttgggcgtctgtcccgcctctgcgcgcggactcgccccaaattcattggcagcggtccttgcctcctctcgcgcagcacattgcgcttctcgaggtgcgcggcccgcgtccacgaagcaacattaccgtctttgacctcggatcaggtagggatacccgctgaacttaagcatatcataa

SEQ ID NO: 582 - DNA, 586 bp, Penicillium citreonigrum
aaaaaacaaggtttccgtaggtgaacctgcggaaggatcattaccgagtgagggccctctgggtccaacctcccacccgtgtttatcgtaccttgttgcttcggcgggcccgccgcaaggccgccggggggcatctgccctctggcccgcgcccgccgaagacaccattgaacgctgtctgaagattgcagtctgagcaattagttaaataacttaaaactttcaacaacggatctcttggttccggcatcgatgaagaacgcagcgaaatgcgatacgtaatgtgaattgcagaattcagtgaatcatcgagtctttgaacgcacattgcgccccctggtattccggggggcatgcctgtccgagcgtcattgctgccctcaagcacggcttgtgtgttgggctccgtcctccttccggggggacgggcccgaaaggcagcggcggcaccgcgtccggtcctcgagcgtatggggcttcgtcacccgctctgcaggcccggccggcgcttgccgacacatcaatcttttttccaggttgacctcggatcaggtagggatacccgctgaacttaagcatatcatag

SEQ ID NO: 583 - DNA, 1083 bp, Unknown
  Kingdom: Fungi, Phylum: Ascomycota, Class: Sordariomycetes, Order: Xylariales, Family: Xylariaceae
ggatcattactgagttatctaaactcccaaccctttgtgaaccttaccgtcgttgcctcggcgggctgtacttaccctgtagctaccctgtagctacccggtaggtgcgctccaagcccgccggtggaccactaaattctattttactactgtatctctgaatgcttcaacttaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctattcgagcgtcatttcaacccttaagcctagttgcttagtgttgggaatctgccctgtatttatagggcagttccttaaagtgatcggcggagttagggcatactctaagcgtagtaatattcttctcgcttctgtagttgtcctggcggcttgccgttaaacccctatatttctagtggttgacctcggattaggtaggaatacccgctgaacttaagcatatcaataagcggaggaaaagaaaccaacagggattgccctagtaacggcgagtgaagcggcaacagctcaaatttgaaatctggccctagcggtccgagttgtaatttgtagaggatgcttttggttaggtgccttctgagttccctggaacgggacgccagagagggtgagagccccgtacggttggacaccgagcctctatatagctccttcgacgagtcgagtagtttgggaatgctgctctaaatgggaggtaaatttcttctaaagctaaataccggccagagaccgatagcgcacaagtagagtgatcgaaagatgaaaagtactttgaaaagagggttaaatagcacgtgaaattgttgaaagggaagcgtttgcgaccagactttttccaggcggatcatccggtgttctcaccggtgcacttcgcctggtttaggccagcatcggttctcttagggggataaaggcctggggaacgtagctccttcgggagtgttatagcccctagcgtaatacccttcgggggacc

SEQ ID NO: 584 - DNA, 1078 bp, Unknown
  Kingdom: Fungi, Phylum: Ascomycota, Class: Sordariomycetes, Order: Xylariales, Family: Xylariaceae
ttatctaaactcccaaccctttgtgaaccttaccgtcgttgcctcggcgggctgtacttaccctgtagctaccctgtagctacccggtaggtgcgctccaagcccgccggtggaccactaaattctattttactactgtatctctgaatgcttcaacttaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctattcgagcgtcatttcaacccttaagcctagttgcttagtgttgggaatctgccctgtatttatagggcagttccttaaagtaatcggcggagttagggcatactctaagcgtagtaatattcttctcgcttctgtagttgtcctggcggcttgccgttaaacccctatatttctagtggttgacctcggattaggtaggaatacccgctgaacttaagcatatcaataagcggaggaaaagaaaccaacagggattgccctagtaacggcgagtgaagcggcaacagctcaaatttgaaatctggccctagcggtccgagttgtaatttgtagaggatgcttttggttaggtgccttctgagttccctggaacgggacgccagagagggtgagagccccgtacggttggacaccgagcctctatatagctccttcgacgagtcgagtagtttgggaatgctgctctaaatgggaggtaaatttcttctaaagctaaataccggccagagaccgatagcgcacaagtagagtgatcgaaagatgaaaagtactttgaaaagagggttaaatagcacgtgaaattgttgaaagggaagcgtttgcgaccagactttttccaggcggatcatcctgtgttctcaccggtgcacttcgcctggtttaggccagcatcggttctcttagggggataaaggcctggggaacgtagctccttcgggagtgttatagcccctagcgtaatacccttcgggggaccgaggaacgc

SEQ ID NO: 585 - DNA, 1046 bp, Unknown
  Kingdom: Fungi, Phylum: Ascomycota, Class: Sordariomycetes, Order: , Family:
ctgctaccctgtaggacctaccctggacctaccccgtagctgctacccggtaagcacgctaaacggcctgccggcggtcttctaaactcttgtcagttattgtgaaattctgaatatctaaaacataataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcattttgacccttaagcccctgttgcttagtgttgggagtctacgactatggcgtagctccttaaagttagttggcggagttagggtatactctcagcgtagtaaaaattttcctcgcttttgtagttatcccaactatagccattaaacccttttattttttttctaaaggttgacctcggatcaggtaggaatacccgctgaacttaagcatatcaataagcggaggaaaagaaaccaacagggattgccttagtaacggcgagtgaagcggcaacagctcaaatttgaaatctggccttcgggtccgagttgtaatttgtagaggatgcttttggcgcggtgccttccaagttccctggaacgggacgccttagagggtgagagccccgtacggttggacgcctagcctctgtaaagctccttcgacgagtcgagtagtttgggaatgctgctctaaatgggaggtaaacttcttctaaagctaaataccggccagagaccgatagcgcacaagtagagtgatcgaaagatgaaaagcactttgaaaagagggttaaatagcacgtgaaattgttgaaagggaagcgtttgcgaccagactttctctaggcggatcatccggtgttctcaccggtgcacttcgcctagtttaggccagcatcggtttctgtagggggataaaggcctggggaatgtggctccctcgggagtgttatagccccttgcgtaatacctttgcggggaccgaggaccgc

SEQ ID NO: 586 - DNA, 1092 bp, Unknown
  Kingdom: Fungi, Phylum: Ascomycota, Class: Sordariomycetes, Order: Xylariales, Family: Xylariaceae
ggatcattactgagttatctaaactcccaaccctttgtgaaccttaccgtcgttgcctcggcgggctgtacttaccctgtagctaccctgtagctacccggtaggtgcgctccaagcccgccggtggaccactaaattctattttactactgtatctctgaatgcttcaacttaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctattcgagcgtcatttcaacccttaagcctagttgcttagtgttgggaatctgccctgtatttatagggcagttccttaaagtgatcggcggagttagggcatactctaagcgtagtaatattcttctcgcttctgtagttgtcctggcggcttgccgttaaacccctatatttctagtggttgacctcggattaggtaggaatacccgctgaacttaagcatatcaataagcggaggaaaagaaaccaacagggattgccctagtaacggcgagtgaagcggcaacagctcaaatttgaaatctggccctagcggtccgagttgtaatttgtagaggatgcttttggttaggtgccttctgagttccctggaacgggacgccagagagggtgagagccccgtacggttggacaccgagcctctatatagctccttcgacgagtcgagtagtttgggaatgctgctctaaatgggaggtaaatttcttctaaagctaaataccggccagagaccgatagcgcacaagtagagtgatcgaaagatgaaaagtactttgaaaagagggttaaatagcacgtgaaattgttgaaagggaagcgtttgcgaccagactttttccaggcggatcatccggtgttctcaccggtgcacttcgcctggtttaggccagcatcggttctcttagggggataaaggcctggggaacgtagctccttcgggagtgttatagcccctagcgtaatacccttcgggggaccgaggaacgc

SEQ ID NO: 587 - DNA, 1039 bp, Unknown
  Kingdom: Fungi, Phylum: Ascomycota, Class: Sordariomycetes, Order: Xylariales, Family: Xylariaceae
tgcctcggcgggctgtacttaccctgtagctaccctgtagctacccggtaggtgcgctccaagcccgccggtggaccactaaattctattttactactgtatctctgaatgcttcaacttaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctattcgagcgtcatttcaacccttaagcctagttgcttagtgttgggaatctgccctgtatttatagggcagttccttaaagtgatcggcggagttagggcatactctgagcgtagtaatattcttctcgcttctgtagttgtcctggcggcttgccgttaaacccctatatttctagtggttgacctcggattaggtaggaatacccgctgaacttaagcatatcaataagcggaggaaaagaaaccaacagggattgccctagtaacggcgagtgaagcggcaacagctcaaatttgaaatctggccctagcggtccgagttgtaatttgtagaggatgcttttggttaggtgccttctgagttccctggaacgggacgccagagagggtgagagccccgtacggttggacaccgagcctctatatagctccttcgacgagtcgagtagtttgggaatgctgctctaaatgggaggtaaatttcttctaaagctaaataccggccagagaccgatagcgcacaagtagagtgatcgaaagatgaaaagtactttgaaaagagggttaaatagcacgtgaaattgttgaaagggaagcgtttgcgaccagactttttccaggcggatcatccggtgttctcaccggtgcacttcgcctggtttaggccagcatcggttctcttagggggataaaggcctggggaacgtagctccttcgggagtgttatagcccctagcgtaatacccttcgggggaccgaggaacgc

SEQ ID NO: 588 - DNA, 543 bp, Unknown
  Kingdom: Fungi, Phylum: Ascomycota, Class: Sordariomycetes, Order: Hypocreales, Family: Nectriaceae, Genus: Fusarium
cattaccgagttattcaactcatcaaccctgtgaacatacctaaacgttgcttcggcgggaatagacggccccgtgaaacgggccgcccccgccagaggacccttaactctgtttctataatgtttcttctgagtaaaacaagcaaataaattaaaactttcaacaacggatctcttggctctggcatcgatgaagaacgcagcgaaatgcgataagtaatgtgaattgcagaattcagtgaatcatcgaatctttgaacgcacattgcgcccgccagtattctggcgggcatgcctgttcgagcgtcattacaaccctcaggcccccgggcctggcgttggggatcggcggagcctctctgtgggcacacgccgtcccccaaatacagtggcggtcccgccgcagcttccatcgcgtagtagctaacacctcgcgactggagagcggcgcggccacgccgtaaaacacccaacttttctgaagttgacctcgaatcaggtaggaatacccgctgaacttaagcatatcaataagcggaggaa

SEQ ID NO: 589 - DNA, 545 bp, Fusarium Sordariomycetes
cattaccgagttatacaactcatcaaccctgtgaacatacctataacgttgcctcggcgggaacagacggccccgtaacacgggccgcccccgccagaggaccccctaactctgtttctataatgtttcttctgagtaaacaagcaaataaattaaaactttcaacaacggatctcttggctctggcatcgatgaagaacgcagcgaaatgcgataagtaatgtgaattgcagaattcagtgaatcatcgaatctttgaacgcacattgcgcccgccagtattctggcgggcatgcctgttcgagcgtcattacaaccctcaggcccccgggcctggcgttggggatcggcggaagccccctgcgggcacaacgccgtcccccaaatacagtggcggtcccgccgcagcttccattgcgtagtagctaacacctcgcaactggagagcggcgcggccacgccgtaaaacacccaacttctgaatgttgacctcgaatcaggtaggaatacccgctgaacttaagcatatcaataagcggaggaaa

SEQ ID NO: 590 - DNA, 644 bp, Unknown
  Kingdom: Fungi, Phylum: Ascomycota, Class: Sordariomycetes, Order: Hypocreales, Family: Nectriaceae, Genus: Fusarium
  misc_feature (45)..(46): n is a, c, g, or t
  misc_feature (625)..(627): n is a, c, g, or t
ttggaagtaaaagtcgtaacaaggtctccgttggtgaaccagcgnngggatcattaccgagtttacaactcccaaacccaatgtgaacgttaccaaactgttgcctcggcgggatctctgccccgggtgcgtcgcagccccggaccaaggcgcccgccggaggaccaacctaaaactcttattgtataccccctcgcgggtttttttataatctgagccttctcggcgcctctcgtaggcgtttcgaaaatgaatcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgtccgagcgtcatttcaaccctcgaacccctccggggggtcggcgttggggatcggccctcccttagcgggtggccgtctccgaaatacagtggcggtctcgccgcagcctctcctgcgcagtagtttgcacactcgcatcgggagcgcggcgcgtccacagccgttaaacacccaacttctgaaatgttgacctcggatcaggtaggaatacccgctgaacttnnncatatcaataagcggga

SEQ ID NO: 591 - DNA, 403 bp, Nectria Nectria
  misc_feature (353)..(353): n is a, c, g, or t
  misc_feature (365)..(365): n is a, c, g, or t
  misc_feature (368)..(368): n is a, c, g, or t
  misc_feature (380)..(381): n is a, c, g, or t
  misc_feature (386)..(387): n is a, c, g, or t
cattaccgagttattcactcatcaaccctgtgaacttacctaaacgttgcttcggcgggaacagacggccctgtaaaacgggccgcccccgccagaggacccctaactctgtttctattatgtttcttctgagtaaaacaagcaaataaattaaaactttcaacaacggatctcttggctctggcatcgatgaagaacgcagcgaaatgcgataagtaatgtgaattgcagaattcagtgaatcatcgaatctttgaacgcacattgcgcccgccagtattctggcgggcatgcctgttcgagcgtcattacaaccctcaggcccccgggcctggcgttggggatcggcgganccccctgcgggnacncgccgtcccccnnatacnntggcggtcccgccgca

SEQ ID NO: 592 - DNA, 569 bp, Fusarium proliferatum
gtaacaaggtctccgttggtgaaccagcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggagga

SEQ ID NO: 593 - DNA, 563 bp, Unknown
  Kingdom: Fungi, Phylum: Ascomycota, Class: Sordariomycetes, Order: Xylariales, Family: Xylariaceae, Genus: Xylaria
ttggaagtaaaagtcgtaacaaggtctccgttggtgaaccagcggagggatcattaaagagttataacaactcccaaacccctgtgaacatacctcatgttgcctcggcaggtcgcgcctcggtgccctgccggcggcccacgaaactctgtttagcattaaattctgaacttataactaaatcagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagccctcgttgcttagcgttgggagcctacaagcactgtagctccccaaagttagtggcggagtcggttcacaccccagacgtagtaagatttcacctcgcctgtagttggaccggtcccctgccgtaaaacacataattttctcaaggttgacctcggatcaggtaggaatacccgctgaacttaagcatatcaataagcggagga

SEQ ID NO: 594 - DNA, 678 bp, Unknown
  Kingdom: Fungi, Phylum: Ascomycota, Class: Sordariomycetes, Order: Xylariales, Family: Xylariaceae, Genus: Hypoxylon
ttggaagtaaaagtcgtaacaaggtctccgttggtgaaccagcggagggatcattactgagttatcaaaactccaaaccctttgtgaaccttaccatcgttgcctcggcgtgagctacggctaccctgtaactaccctggagctaccctagagttaccctatagctaccctgcacttaccctgcagctaccctatagctaccctggagctaccctggagctaccctgtagtcggcttcggcccgccgaaggaccgttaaactcttgtttttaccactgtttctctgaattttaaaccaaaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctattcgagcgtcatttcgacccctaagcccctgttgcttagcgttgggaatctacggcgtagttcctcaaagttagtggcggagttagggtacactctcagcgtagtaatttctctcgctcgtgtggtggccctggctgctagccgttaaaacccctatattttctagtggttgacctcggattaggtaggaatacccgctgaacttaagcatatcaataagcggagg

SEQ ID NO: 595 - DNA, 531 bp, Fusarium proliferatum
attaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggagg

SEQ ID NO: 596 - DNA, 609 bp, Unknown
  Kingdom: Fungi, Phylum: Ascomycota, Class: Sordariomycetes, Order: Xylariales, Family: Xylariaceae, Genus: Xylaria
tggaagtaaaagtcgtaacaaggtctccgttggtgaaccagcggagggatcattaaagagttttctacaactcccaaacccctgtgaacataccttttgttgcctcggcaggcctcgcctaccttgtagtgcccctacgctgtaggggcctacctggggagtgcgggggggccctgccggcggcccgcgaaactctgtttagcactgaattctgaacatataactaaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcccctgttgcttagcgttgggagcctacggcagcgtagctccccaaagttagtggcgtggtcggttcacactccagacgtagtaaattttcacctcgcctgtagtcggaccggtcccctgccgtaaaacaccccaatttccaaaggttgacctcggatcaggtaggaatacccgctgaacttaagcatatcaataagcggaggaa

SEQ ID NO: 597 - DNA, 679 bp, Unknown
  Kingdom: Fungi, Phylum: Ascomycota, Class: Sordariomycetes, Order: Xylariales, Family: Xylariaceae, Genus: Xylaria
tggaagtaaaagtcgtaacaaggtctccgttggtgaaccagcggagggatcattactgagttatcaaaactccaaaccctttgtgaaccttaccgtcgttgcctcggcgtgagctacggctaccctgtaactaccctggagctaccctagagttaccctatagctaccctgcacttaccctgcagctaccctatagctaccctggagctaccctggagctaccctgtagtcggcttcggcccgccgaaggaccgttaaactcttgtttttaccactgtttctctgaattttaaactaaaataagttaaaactttcaacaacggatctcttggttctggcatcgatgaagaacgcagcgaaatgcgataagtaatgtgaattgcagaattcagtgaatcatcgaatctytgaacgcacattgcgcccattagtattctagygggcatgcctattcgagcgtcatttcgacccctaagcccctgttgcttagcgttgggaatctacggcgtagttcctcaaagttagtggcggagttagggtacactctcagcgtagtaatttctctcgctcgtgtggtggccctggctgctagccgttaaaacccctaaattttctagtggttgacctcggattaggtaggaatacccgctgaacttaagcatatcaataaagcggagga

SEQ ID NO: 598 - DNA, 538 bp, Unknown
  Kingdom: Fungi, Phylum: Ascomycota, Class: Sordariomycetes, Order: Hypocreales, Family: Nectriaceae, Genus: Fusarium
cattaccgagttatacaactcatcaaccctgtgaacatacctaaaacgttgcttcggcgggaacagacggccccgtaacacgggccgcccccgccagaggaccccctaactctgtttctattatgtttcttctgagtaaaacaagcaaataaattaaaactttcaacaacggatctcttggctctggcatcgatgaagaacgcagcgaaatgcgataagtaatgtgaattgcagaattcagtgaatcatcgaatctttgaacgcacattgcgcccgccagtattctggcgggcatgcctgttcgagcgtcattacaaccctcaggcccccgggcctggcgttggggatcggcgaggcgccccctgcgggcacacgccgtcccccaaatacagtggcggtcccgccgcagcttccattgcgtagtagctaacacctcgcaactggagagcggcgcggccatgccgtaaaacacccaacttctgaatgttgacctcgaatcaggtaggaatacccgctgaacttaagcatatcaataagc

SEQ ID NO: 599 - DNA, 1012 bp, Preussia minima
aacacccttgacctttttgagtaccttttcgtttcctcggcaggctcgcctgccaacggggaccccaaaaacgctttgtaatacctgtcattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcctcccctcgcggggggactcgcctcaaaaacattggcggccggtacattggcttcgagcgcagcagaaacgcggtctcgagcccggtggatcggctcccataagcctcttcttttattttgacctcggatcaggtagggatacccgctgaacttaagcatatcaataagcggaggaaaagaaaccaacagggattgccctagtaacggcgagtgaagcggcaacagctcaaatttgaaatctggccctttcagggtccgagttgtaatttgtagagggtgctttggcgttggctgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctatgggcaggccagcatcagtcccagcggttggataaatgcctgttgaatgtacctctcttcggggaggacttatagcctcgggcggcatacaaccagccggg

SEQ ID NO: 600 - DNA, 907 bp, Preussia minima
tttcctcggtcaggctcgcctgccaacggggaccccaaaaacgctttgtaatacctgtcattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcctcccctcgcggggggactcgcctcaaaaacattggcggccggtacattggcttcgagcgcagcagaaacgcggtctcgagcccggtggatcggctcccataagcctcttcttttattttgacctcggatcaggtagggatacccgctgaacttaagcatatcaataagcggaggaaaagaaaccaacagggattgccctagtaacggcgagtgaagcggcaacagctcaaatttgaaatctggccctttcagggtccgagttgtaatttgtagagggtgctttggcgttggctgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctatgggcaggccagcatcagtcccagcg

SEQ ID NO: 601 - DNA, 1025 bp, Preussia minima
cccattcgagataacacccttgcctttttgagtaccttttcgtttcctcggcaggctcgcctgccaacggggaccccaaaaacgctttgtaatacctgtcattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcctcccctcgcggggggactcgcctcaaaaacattggcggccggtacattggcttcgagcgcagcagaaacgcggtctcgagcccggtggatcggctcccataagcctcttcttttattttgacctcggatcaggtagggatacccgctgaacttaagcatatcaataagcggaggaaaagaaaccaacagggattgccctagtaacggcgagtgaagcggcaacagctcaaatttgaaatctggccctttcagggtccgagttgtaatttgtagagggtgctttggcgttggctgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctatgggcaggccagcatcagtcccagcggttggataaatgcctgttgaatgtacctctcttcggggaggacttatagcctcgggcggcatacaaccagccgggat

SEQ ID NO: 602 - DNA, 585 bp, Fusarium proliferatum
  misc_feature (15)..(15): n is a, c, g, or t
ttggaagtaaaagtngtaacaaggtctccgttggtgaaccagcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggaggaa

SEQ ID NO: 603 - DNA, 534 bp, Fusarium proliferatum
tcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggagga

SEQ ID NO: 604 - DNA, 584 bp, Fusarium proliferatum
ttggaagtaaaagtcgtaacaaggtctccgttggtgaaccagcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggagga

SEQ ID NO: 605 - DNA, 1009 bp, Preussia minima
gggcttcggcccattcgagataacacccttgcctttttgagtaccttttcgtttcctcggcaggctcgcctgccaacggggaccccaaaaacgctttgtaatacctgtcattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcctcccctcgcggggggactcgcctcaaaaacattggcggccggtacattggcttcgagcgcagcagaaacgcggtctcgagcccggtggatcggctcccataagcctcttcttttattttgacctcggatcaggtagggatacccgctgaacttaagcatatcaataagcggaggaaaagaaaccaacagggattgccctagtaacggcgagtgaagcggcaacagctcaaatttgaaatctggccctttcagggtccgagttgtaatttgtagagggtgctttggcgttggctgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctacgggcaggccagcatcagtcccagcggttggataaatgcctgttgaatgtacctctcttcggggaggacttatagcct

SEQ ID NO: 606 - DNA, 1078 bp, Paraconiothyrium hawaiiense
ggtgttggttgcggcctccgggggttctccccccgggtggtagaggtaacactctcacgcgccacatgccttaatcctttttttacgagcacctttcgttctccttcggtggggcaacctgccgctggaacttatcaaaaacctttttttgcatctagcattacctgttctgatacaaacaatcgttacaactttcaacaatggatctcttggctctggcatcgatgaagaacgcagcgaaatgcgataagtagtgtgaattgcagaattcagtgaatcatcgaatctttgaacgcacattgcgccccttggtattccatggggcatgcctgttcgagcgtcatctacaccctcaagctctgcttggtgttgggcgtctgtcccgcctctgcgcgcggactcgccccaaattcattggcagcggtccttgcctcctctcgcgcagcacattgcgcttctcgaggtgcgcgggccgcgtccacgaagcaacattaccgtctttgacctcggatcaggtagggatacccgctgaacttaagcatatcaataagcggaggaaaagaaaccaacagggattgccctagtaacggcgagtgaagcggcaacagctcaaatttgaaatctggctctctttgggggtccgagttgtaatttgcagaggatgctttggcattggcggcggtctaagttccttggaacaggacatcgcagagggtgagaatcccgtacgtgggcgcctgcctttgccgtgtaaagctccttcgacgagtcgagttgtttgggaatgcagctctaaatgggaggtaaatttcttctaaagctaaataccggccagagaccgatagcgcacaagtagagtgatcgaaagatgaaaagtactttggaaagagagtcaaaaagcacgtgaaattgttgaaagggaagcgcttgcagccagacttgcccgcagttgctcacctaggctttggcctggggcactcttctgtgggcaggccagcatcagtttgggcggttggataaaggcctctgtcacgtatcttccttcgggaagaccttataggggaggcgtaatgcaacc

SEQ ID NO: 607 - DNA, 1006 bp, Paraconiothyrium hawaiiense
ggtggtagaggtaacactctcacgcgccacatgccttaatcctttttttacgagcacctttcgttctccttcggtggggcaacctgccgctggaacttatcaaaaacctttttttgcatctagcattacctgttctgatacaaacaatcgttacaactttcaacaatggatctcttggctctggcatcgatgaagaacgcagcgaaatgcgataagtagtgtgaattgcagaattcagtgaatcatcgaatctttgaacgcacattgcgccccttggtattccatggggcatgcctgttcgagcgtcatctacaccctcaagctctgcttggtgttgggcgtctgtcccgcctctgcgcgcggactcgccccaaattcattggcagcggtccttgcctcctctcgcgcagcacattgcgcttctcgaggtgcgcgggccgcgtccacgaagcaacattaccgtctttgacctcggatcaggtagggatacccgctgaacttaagcatatcaataagcggaggaaaagaaaccaacagggattgccctagtaacggcgagtgaagcggcaacagctcaaatttgaaatctggctctctttgggggtccgagttgtaatttgcagaggatgctttggcattggcggcggtctaagttccttggaacaggacatcgcagagggtgagaatcccgtacgtgggcgcctgcctttgccgtgtaaagctccttcgacgagtcgagttgtttgggaatgcagctctaaatgggaggtaaatttcttctaaagctaaataccggccagagaccgatagcgcacaagtagagtgatcgaaagatgaaaagtactttggaaagagagtcaaaaagcacgtgaaattgttgaaagggaagcgcttgcagccagacttgcccgcagttgctcacctaggctttggcctggggcactcttctgtgggcaggccagcatcagtttgggcggttggataaaggcctctgtcacgtatcttc

SEQ ID NO: 608 - DNA, 1050 bp, Unknown
  Kingdom: Fungi, Phylum: Ascomycota, Class: Dothideomycetes, Order: Pleosporales, Family:
ttacctagagttgtaggctttgcctgctatctcttacccatgtcttttgagtacttacgtttcctcggcgggtccgcccgccgactggacaatttaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaataagcggaggaaaagaaaccaacagggattgccctagtaacggcgagtgaagcggcaacagctcaaatttgaaatctggcgtctttggcgtccgagttgtaatttgcagagggcgctttggcattggcagcggtccaagttccttggaacaggacgtcacagagggtgagaatcccgtacgtggtcgctagcctttaccgtgtaaagccccttcgacgagtcgagttgtttgggaatgcagctctaaatgggaggtaaatttcttctaaagctaaatactggccagagaccgatagcgcacaagtagagtgatcgaaagatgaaaagcactttggaaagagagttaaaaagcacgtgaaattgttgaaagggaagcgcttgcagccagacttgcctgtagttgctcatccgggtttctacccggtgcactcttctataggcaggccagcatcagtttgggcggttggataaaggtctctgtcatgtacctctcttcggggagaacttataggggagacgacatgcaaccagcccggactgaggtccgc

SEQ ID NO: 609 - DNA, 579 bp, Lecythophora hoffmannii
gtaacaaggtctccgttggtgaaccagcggagggatcattacaagaagccgaaaggctacttcaaaccatcgcgaactcgtccaagttgcttcggcggcgcggcaccccttaacgggggcgccgcagccctgcctctccggaggtttggggcgcccgccggaggtacgaaactctgtattatagtggcatctctgagtataaaacaaataagttaaaactttcaacaacggatctcttggttctggcatcgatgaagaacgcagcgaaatgcgataagtaatgtgaattgcagaattcagtgaatcatcgaatctttgaacgcacattgcgcccggtagtactctaccgggcatgcctgttcgagcgtcatttcaaccctcaagccctgcttggtgttggggccctacggctgccgtaggccctgaaaggaagtggcgggctcgctacaactccgagcgtagtaattcattatctcgctagggaggttgcggcgtgctcctgccgttaaagacccatctttaaccaaggttgacctcggatcaggtaggaatacccgctgaacttaagcatatcaataa

SEQ ID NO: 610 - DNA, 550 bp, Phoma brasiliensis
gtaacaaggtttccgtaggtgaacctgcggaaggatcattacctagagttgtaggctttgcctgctatctcttacccatgtcttttgagtacttacgtttcctcggcgggtccgcccgccgactggacaatttaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaataagcggagg

SEQ ID NO: 611 - DNA, 1030 bp, Neurospora terricola
tcgcgaatcttacccgtacggttgcctcggcgctggcggtccggaaggccctcgggccccccggatcctcgggtctcccgctcgcgggaggctgcccgccggagtgccgaaaccaaactcttgatattttatgtctctctgagtaaacttttaaataagtcaaaactttcaacaacggatctcttggttctggcatcgatgaagaacgcagcgaaatgcgataagtaatgtgaattgcagaattcagtgaatcatcgaatctttgaacgcacattgcgctcgccagtattctggcgagcatgcctgttcgagcgtcatttcaaccatcaagctctgcttgcgttggggatccgcgtctgacgcggtccctcaaaaacagtggcgggctcgctagtcacaccgagcgtagtaactctacatcgctatggtcgtgcggcgggttcttgccgtaaaaccccccaatttttaaggttgacctcggatcaggtaggaatacccgctgaacttaagcatatcaataagcggaggaaaagaaaccaacagggattgccctagtaacggcgagtgaagcggcaacagctcaaatttgaaatctggcttcggcccgagttgtaatttgtagaggaaacttttggtgaggcaccttctgagtcccttggaacagggcgccatagagggtgagagccccgtatagtcggatgccgatccaatgtaaagttccttcgacgagtcgagtagtttgggaatgctgctcaaaatgggaggtaaatttcttctaaagctaaatataggccagagaccgatagcgcacaagtagagtgatcgaaagatgaaaagcactttgaaaagagggttaaatagcacgtgaaattgttgaaagggaagcgtttgtgaccagacttgcgccgttccgatcatccggtgttctcaccggtgcactcggggcggctcaggccagcatcggttttggtggggggataaaggttcggggaacgtagctcctccgggagtgttatagccccgggcgtaa

SEQ ID NO: 612 - DNA, 1025 bp, Unknown
  Kingdom: Fungi, Phylum: Ascomycota, Class: Dothideomycetes, Order: , Family:
ggcttcggccctgtcgagatagaacccttgcctttttgagtacctcttgtttcctcggcgggctcgcccgccgatggaccccccaaaaaacactttgcagtacctgtaatagtctgaacaacaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgttgggtgactgtcccctcaaaaggactcgcctcaaaatcattggcggccggtacgttggcttcgagcgcagcagaaacgcgaactcggagactgtgtgtcggctcccagaagccatctttaaattttgacctcggatcaggtagggatacccgctgaacttaagcatatcaataagcggaggaaaagaaaccaacagggattgccctagtaacggcgagtgaagcggcaacagctcaaatttgaaatctggctctttcagggtccgagttgtaatttgtagagggtgctttggagttgactgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctacaggcaggccagcatcagtcctggcggttggataaatgcctgctaaatgtacctctcttcggggaggacttatagtttcaggcggcatacaaccagccggga

SEQ ID NO: 613 - DNA, 958 bp, Unknown
  Kingdom: Fungi, Phylum: Ascomycota, Class: Dothideomycetes, Order: Capnodiales, Family: Davidiellaceae, Genus: Cladosporium
aaccctttgatttccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgtccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcgacgtccgagttgtaatttgtagaggatgcttctgagtggccaccgacctaagttccttggaacaggacgtcatagagggtgagaatcccgtatgcggtcggaaaggcgctctatacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttaaaagggaagggattgcaaccagacttgctcgcggtgttccgccggtcttctgaccggtctactcgccgcgttgcaggccagcatcgtctggtgccgctggataagacttgaggaat

SEQ ID NO: 614 - DNA, 957 bp, Preussia minima
taccttttcgtttcctcggcaggctcgcctgccaacggggaccccaaaaacgctttgtaatacctgtcattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcctcccctcgcggggggactcgcctcaaaaacattggcggccggtacattggcttcgagcgcagcagaaacgcggtctcgagcccggtggatcggctcccataagcctcttcttttattttgacctcggatcaggtagggatacccgctgaacttaagcatatcaataagcggaggaaaagaaaccaacagggattgccctagtaacggcgagtgaagcggcaacagctcaaatttgaaatctggccctttcagggtccgagttgtaatttgtagagggtgctttggcgttggctgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctatgggcaggccagcatcagtcccagcggttggataaatgcctgttgaatgtacctctcttcggggagg

SEQ ID NO: 615 - DNA, 905 bp, Unknown
  Kingdom: Fungi, Phylum: Ascomycota, Class: Dothideomycetes, Order: Capnodiales, Family: Davidiellaceae, Genus: Cladosporium
ggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgtccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcgacgtccgagttgtaatttgtagaggatgcttctgagtggccaccgacctaagttccttggaacaggacgtcatagagggtgagaatcccgtatgcggtcggaaaggcgctctatacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttaaaagggaagggattgcaaccagacttgctcgcggtgttccgccggtcttctgaccggtctactcgccgcgttgcaggccagcatcgtctggtgccgctggataagacttga

SEQ ID NO: 616 - DNA, 990 bp, Unknown
  Kingdom: Fungi, Phylum: Ascomycota, Class: Dothideomycetes, Order: Pleosporales, Family: Pleosporales Incertae sedis, Genus: Periconia
tcgagataacacccttgcctttttgagtaccttttcgtttcctcggcagctcgcctgccaacggggaccccaaaaacgctttgtaatacctgtcattgctgatataacaagcaaaaattaaaactttcaacaacggatctcttggtttggcatcgatgaagaacgcagcgaaatgcgataagtagtgtgaattgcaaattcagtgaatcatcgaatctttgaacgcacattgcgccctttggtatccttagggcatgcctgttcgagcgtcatttaaaccttcaagctcagcttgtgatgggtgactgtcctcccctcgcggggggactcgcctcaaaaacatggcggccggtacattggcttcgagcgcagcagaaacgcggtctcgagccggtggatcggctcccataagcctcttcttttattttgacctcggatcagtagggatacccgctgaacttaagcatatcaataagcggaggaaaagaaacaacagggattgccctagtaacggcgagtgaagcggcaacagctcaaattgaaatctggccctttcagggtccgagttgtaatttgtagagggtgcttggcgttggctgtggtctaagttccttggaacaggacgtcgcagagggtggaatcccgtatgtggccgccagtcttcgccgtgtaaagccccttcgacggtcgagttgtttgggaatgcagctctaaatgggaggtaaatttcttctaagctaaatattggccagagaccgatagcgcacaagtagagtgatcgaaaatgaaaagcactttggaaagagagtcaaaaagcacgtgaaattgttgaagggaagcgcttgcagccagacttgcctgtagttgctcatccgggcttttcccggtgcactcttctatgggcaggccagcatcagtcccagcggttggaaaatgcctgttgaatgtacctctcttcggggaggacttatagcctcgggggcatacaac

SEQ ID NO: 617 - DNA, 980 bp, Unknown
  Kingdom: Fungi, Phylum: Ascomycota, Class: Dothideomycetes, Order: Pleosporales, Family: Pleosporales Incertae sedis, Genus: Periconia
agatagaacccttgcctttttgagtacctcttgtttcctcggcgggctccccgccgatggaccccccaaaaaacactttgcagtacctgtaatagtctaacaacaaacaaaaattaaaactttcaacaacggatctcttggttctggatcgatgaagaacgcagcgaaatgcgataagtagtgtgaattgcagaatcagtgaatcatcgaatctttgaacgcacattgcgccctttggtattcctagggcatgcctgttcgagcgtcatttaaaccttcaagctcagcttggtgtgggtgactgtcccctcaaaaggactcgcctcaaaatcattggcggccgtacgttggcttcgagcgcagcagaaacgcgaactcggagactgtgtgtcgctcccagaagccatctttaaattttgacctcggatcaggtagggataccgctgaacttaagcatatcaataagcggaggaaaagaaaccaacagggatgccctagtaacggcgagtgaagcggcaacagctcaaatttgaaatctgctctttcagggtccgagttgtaatttgtagagggtgctttggagttgacgtggtctaagttccttggaacaggacgtcgcagagggtgagaatcccgttgtggccgccagtcttcgccgtgtaaagccccttcgacgagtcgagttgttgggaatgcagctctaaatgggaggtaaatttcttctaaagctaaatatggccagagaccgatagcgcacaagtagagtgatcgaaagatgaaaagcctttggaaagagagtcaaaaagcacgtgaaattgttgaaagggaagcgctgcagccagacttgcctgtagttgctcatccgggcttttgcccggtgcatcttctacaggcaggccagcatcagtcctggcggttggataaatgcctgtaaatgtacctctcttcggggaggacttatagtttcaggcggcatacaa

SEQ ID NO: 618 - DNA, 915 bp, Unknown
  Kingdom: Fungi, Phylum: Ascomycota, Class: Dothideomycetes, Order: Pleosporales, Family: Pleosporaceae, Genus: Alternaria
tttcctcggcgggtccgcccgccgactggacaatttaaaccctttgcagtgcaatcagcgtctgaaaaaacttaatagttacaactttcaacaacggactcttggttctggcatcgatgaagaacgcagcgaaatgcgataagtagttgaattgcagaattcagtgaatcatcgaatctttgaacgcacattgcgcccttggtattccatggggcatgcctgttcgagcgtcatttgtaccttcagctctgcttggtgttgggtgtttgtctcgcctctgcgtgtagactcgcctaaaacaattggcagccggcgtattgatttcggagcgcagtacatctcggctttgcactcataacgacgacgtccaaaagtacatttttacactcttgcctcggatcaggtagggatacccgctgaacttaagcatatcaataagcgaggaaaagaaaccaacagggattgccctagtaacggcgagtgaagcggcacagctcaaatttgaaatctggcgtctttggcgtccgagttgtaatttgagagggcgctttggcattggcagcggtccaagttccttggaacaggacgcacagagggtgagaatcccgtacgtggtcgctagcctttaccgtgtaaaccccttcgacgagtcgagttgtttgggaatgcagctctaaatgggaggtaatttcttctaaagctaaatactggccagagaccgatagcgcacaagtaagtgatcgaaagatgaaaagcactttggaaagagagttaaaaagcacgtaaattgttgaaagggaagcgcttgcagccagacttgcctgtagttgctctccgggtttctacccggtgcactcttctataggcaggccagcatcagttgggcggttggataaaggtctctgtcatgtacct

SEQ ID NO: 619 - DNA, 958 bp, Unknown
  Kingdom: Fungi, Phylum: Ascomycota, Class: Dothideomycetes, Order: Pleosporales, Family: Pleosporales Incertae sedis, Genus: Periconia
tacctcttgtttcctcggcgggctcgcccgccgatggaccccccaaaaacactttgcagtacctgtaatagtctgaacaataaacaaaaattaaaacttcaacaacggatctcttggttctggcatcgatgaagaacgcagcgaaatcgataagtagtgtgaattgcagaattcagtgaatcatcgaatctttgaagcacattgcgccctttggtattccttagggcatgcctgttcgagcgtcattaaaccttcaagctcagcttggtgttgggtgactgtccccctcaaaaggactcgcctcaaaatcattggcggccggtacgttggcttcgagcgcagcgaaacgcgaactcggagactttgtgtcggctcccagaagccatctttaattttgacctcggatcaggtagggatacccgctgaacttaagcatatcaaaagcggaggaaaagaaaccaacagggattgccctagtaacggcgagtgagcggcaacagctcaaatttgaaatctggctctttcagggtccgagttgtatttgtagagggtgctttggagttgactgtggtctaagttccttggaacggacgtcgcagagggtgagaatcccgtatgtggccgccagtcttcgccggtaaagccccttcgacgagtcgagttgtttgggaatgcagctctaaatggaggtaaatttcttctaaagctaaatattggccagagaccgatagcgcaaagtagagtgatcgaaagatgaaaagcactttggaaagagagtcaaaaacacgtgaaattgttgaaagggaagcgcttgcagccagacttgcctgtagtgctcatccgggcttttgcccggtgcactcttctacaggcaggccagcacagtcctggcggttggataaatgcctgctaaatgtacctctcttcggggggacttatagtttcaggcggcatacaa

SEQ ID NO: 620 - DNA, 875 bp, Unknown
  Kingdom: Fungi, Phylum: Ascomycota, Class: Dothideomycetes, Order: Pleosporales, Family: Pleosporaceae, Genus: Alternaria
actggacaatttaaaccctttgcagttgcaatcagcgtctgaaaaacatatagttacaactttcaacaacggatctcttggttctggcatcgatgaagacgcagcgaaatgcgataagtagtgtgaattgcagaattcagtgaatcacgaatctttgaacgcacattgcgccccttggtattccatggggcatgccgttcgagcgtcatttgtaccttcaagctttgcttggtgttgggtgtttgctcgcctctgcgtgtagactcgccttaaaacaattggcagccggcgtatgatttcggagcgcagtacatctcgcgctttgcactcataacgacgacgtcaaaagtacatttttacactcttgacctcggatcaggtagggatacccgtgaacttaagcatatcaataagcggaggaaaagaaaccaacagggattgcctagtaacggcgagtgaagcggcaacagctcaaatttgaaatctggcgctttggcgtccgagttgtaatttgcagagggcgctttggcattggcagcgtccaagttccttggaacaggacgtcacagagggtgagaatcccgtacgggtcgctagcctttaccgtgtaaagccccttcgacgagtcgagttgtttggaatgcagctctaaatgggaggtaaatttcttctaaagctaaatactgccagagaccgatagcgcacaagtagagtgatcgaaagatgaaaagcacttggaaagagagttaaaaagcacgtgaaattgttgaaagggaagcgcttgagccagacttgcctgtagttgctcatccgggtttctacccggtgcactctctataggcaggccagcatcagtttgggcggttggataaagg

SEQ ID NO: 621 - DNA, 983 bp, Unknown
  Kingdom: Fungi, Phylum: Ascomycota, Class: Dothideomycetes, Order: Pleosporales, Family: Pleosporales Incertae sedis, Genus: Periconia
tacctttcgtttcctcggcaggctcgcctgccaatggggaccacaaaaaacactttgcagtacctgtaacagtctgaacaaacaaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctaagcttggtgttgggtgactgtccgcttcactgcggactcgcctcaaaattattggcggccggtacattggcttcgagcgcagcagaaacgcgaactcgggcccgtcgtattggctcccagaagctatcttcacaattttgacctcggatcaggtagggatacccgctgaacttaagcatatcaataagcggaggaaaagaaaccaacagggattgccctagtaacggcgagtgaagcggcaacagctcaaatttgaaatctggctctttcagggtccgagttgtaatttgtagagggtgctttggagttgactgtggtctaagttccttggaacaggacgtcgcagagggtgagaatcccgtatgtggccgccagtcttctccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctataggcaggccagcatcagtcgcggcggttggataaatgtctgcacaatgtacctctcttcggggaggacttatagggcaggcggcatacaaccag

SEQ ID NO: 622 - DNA, 969 bp, Unknown
  Kingdom: Fungi, Phylum: Ascomycota, Class: Dothideomycetes, Order: Capnodiales, Family: Davidiellaceae, Genus: Cladosporium
tccgactctgttgcctccggggcgaccctgccttcgggcgggggctccggtggacacttcaaactcttgcgtaactttgcagtctgagtaaacttaataataaattaaaacttttaacaacggatctcttggttctggcatcgatgagaacgcagcgaaatgcgataagtaatgtgaattgcagaattcagtgaatatcgaatctttgaacgcacattgcgccccctggtattccggggggcatgctgttcgagcgtcatttcaccactcaagcctcgcttggtattgggcaaccggtccgccgcgtgcctcaaatcgaccggctgggtcttctgtcccctaacgttgtggaaactattcgctaaagggtgttcgggaggctacgccgtaaacaaccccatttctaaggttgacctcggatcaggtagggatacccgctgacttaagcatatcaataagcggaggaaaagaaaccaacagggattgctctgtaacggcgagtgaagcagcaatagctcaaatttgaaatctggcgtcttgacgtccgagttgtaatttgtagaggatgcttctgagtaaccaccgaccaagttccttggaacaggacgtcatagagggtgagaatcccgtatgcggtggaaaggtgctctatacgtagctccttcgacgagtcgagttgtttgggatgcagctctaaatgggaggtaaatttcttctaaagctaaatattggccaagaccgatagcgcacaagtagagtgatcgaaagatgaaaagcactttggaagagagttaaaaagcacgtgaaattgttaaaagggaagggattgcaacagacttgctcgcggtgttccgccggtcttctgaccggtctactcgccgcttgcaggccagcatcgtctggtgccgctggataagacttgaggaatgtactccctcgggagtgttatagcctcttgtgatgcagcga

SEQ ID NO: 623 - DNA, 255 bp, Unknown
  Kingdom: Fungi, Phylum: Ascomycota, Class: Dothideomycetes, Order: Dothideales, Family:
ggtgctcagcgcccgacctccaaccctctgttgttaaaactaccttgttgctttggcgggaccgcccggtctccgagccgccggggccctcaccggcccaggcgagcgcccgccagagttaaaccaaactcttgttataaaccggtcgtctgagtaaaagtttttaataaatcaaaactttcaacaacggatctcttggttctcgcatcgatgaagaacgcagcgaaatgcgataagtaatgtgaattgcagaat

SEQ ID NO: 624 - DNA, 255 bp, Unknown
  Kingdom: Fungi, Phylum: Ascomycota, Class: Dothideomycetes, Order: Pleosporales, Family: Leptosphaeriaceae, Genus: Coniothyrium
ttgacctgccctgtctgaatattctacccatgtcttttgcgtactatttgtttccttggtgggcttgcccaccattaggacactataaaaccttttgtaattgcagtcagcgtcagaaataacttaatagttacaactttcaacaacggatctcttggttctggcatcgatgaagaacgcagcgaaatgcgataagtagtgtgaattgcagaattcagtgaatcatcgaatctttgaacgcacattgcgcccctt

SEQ ID NO: 625 - DNA, 1024 bp, Unknown
  Kingdom: Fungi, Phylum: Ascomycota, Class: Dothideomycetes, Order: Pleosporales, Family: Pleosporaceae, Genus: Alternaria
tgtaggctttgcctgctatctcttacccatgtcttttgagtacttacgtttcctcggcgggtccgcccgccgactggacaatttaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaataagcggaggaaaagaaaccaacagggattgccctagtaacggcgagtgaagcggcaacagctcaaatttgaaatctggcgtctttggcgtccgagttgtaatttgcagagggcgctttggcattggcagcggtccaagttccttggaacaggacgtcacagagggtgagaatcccgtacgtggtcgctagcctttaccgtgtaaagccccttcgacgagtcgagttgtttgggaatgcagctctaaatgggaggtaaatttcttctaaagctaaatactggccagagaccgatagcgcacaagtagagtgatcgaaagatgaaaagcactttggaaagagagttaaaaagcacgtgaaattgttgaaagggaagcgcttgcagccagacttgcctgtagttgctcatccgggtttctacccggtgcactcttctataggcaggccagcatcagtttgggcggttggataaaggtctctgtcatgtacctctcttcggggagaacttataggggagacgacatgcaaccagcc

SEQ ID NO: 626 - DNA, 973 bp, Unknown
  Kingdom: Fungi, Phylum: Ascomycota, Class: Dothideomycetes, Order: Pleosporales, Family: Pleosporaceae, Genus: Alternaria
actcttgcctagtctgcgtgaatattcacccatgtttttgcgtacttcttgtttccttggtgggctcgcccgccaaatggacactgttaaaccttttgtaattgcagtcagcgtcagtacaatttaattattacaactttcaacaacggatctcttggttctggcatcgatgaagaacgcagcgaaatgcgatacgtagtgtgaattgcagaattcagtgaatcatcgaatctttgaacgcacattgcgcccattggtattccaatgggcatgcctgttcgagcgtcatttgtaccctcaagctttgcttggtgttgggcgtttgtcctgcgggactcgccttaaaacgattggcagccggcacactggtttggagcgcagcacaaattgcggtctagccatgaatgtcggcgtccatgaagccctatttcacttttgacctcggatcaggtagggatacccgctgaacttaagcatatcaataagcggaggaaaagaaaccaacagggattgcctcagtaacggcgagtgaagcggcatcagctcaaatttgaaatctggctctttcagggtccgagttgtaatttgcagagggcgctttggcataggcagcgattcaagtcccttggaacagggcgtcacagagggtgagaatcccgtacgtggtcgctagctcttgccgtgtaaagccccttcgacgagtcgagttgtttgggaatgcagctctaaatgggaggtaaatttcttctaaagctaaatactggccagagaccgatagcgcacaagtagagtgatcgaaagatgaaaaaaactttggaaagagagttaaacagcatgtgaaattgttgaaagggaagcgcttgcagccagacttgcctgtagttgctcatccgggctcttgcccggtgcactcttctgtaggcaggccagcatcagtttgggcggttggataaaggtctctgtcatgtaccgc

SEQ ID NO: 627 - DNA, 930 bp, Unknown
  Kingdom: Fungi, Phylum: Ascomycota, Class: Dothideomycetes, Order: Pleosporales, Family: Pleosporales Incertae sedis, Genus: Periconia
tcctcggcaggctcgcctgccaatggggaccccaacaaacactttgcagtacctgtaaacagtctgaacaaactttaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgttgggtgactgtccgcttgcggactcgcctcaaaatgattggcggccggtacttttggcttcgagcgcagcagaaacgcgaactcgaggcctgtgtgctggctcccagaagctatcttcacaattttgacctcggatcaggtagggatacccgctgaacttaagcatatcaataagcggaggaaaagaaaccaacagggattgccctagtaacggcgagtgaagcggcaacagctcaaatttgaaatctggctctttcagggtccgagttgtaatttgtagagggtgctttggagttgactgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctatgggcaggccagcatcagtcctggcggtcggataaatgcctgctgaatgtacctctc

SEQ ID NO: 628 - DNA, 1046 bp, Unknown
  Kingdom: Fungi, Phylum: Ascomycota, Class: Dothideomycetes, Order: Pleosporales, Family: Pleosporales Incertae sedis, Genus: Periconia
tatcgtagggcttcggccctgtcgagatagaacccttgcctttttgagtacctcttgtttcctcggcgggctcgcccgccgatggaccccccaaaaaacactttgcagtacctgtaatagtctgaacaacaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgttgggtgactgtccccctcaaaagggactcgcctcaaaatcattggcggccggtacgttggcttcgagcgcagcagaaacgcgaactcggagactttgtgtcggctcccagaagccatctttaaattttgacctcggatcaggtagggatacccgctgaacttaagcatatcaataagcggaggaaaagaaaccaacagggattgccctagtaacggcgagtgaagcggcaacagctcaaatttgaaatctggctctttcagggtccgagttgtaatttgtagagggtgctttggagttgactgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctacaggcaggccagcatcagtcctggcggttggataaatgcctgctaaatgtacctctcttcggggaggacttatagtttcaggcggcatacaaccagccgggattgaggtccgc

SEQ ID NO: 629 - DNA, 990 bp, Unknown
  Kingdom: Fungi, Phylum: Ascomycota, Class: Dothideomycetes, Order: Capnodiales, Family: Davidiellaceae, Genus: Cladosporium
tccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcgacgtccgagttgtaatttgtagaggatgcttctgagtaaccaccgacctaagttccttggaacaggacgtcatagagggtgagaatcccgtatgcggtcggaaaggtgctctatacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttaaaagggaagggattgcaaccagacttgctcgcggtgttccgccggtcttctgaccggtctactcgccgcgttgcaggccagcatcgtctggtgccgctggataagacttgaggaatgtagctccctcgggagtgttatagcctcttgtgatgcagcgagc

SEQ ID NO: 630 - DNA, 1036 bp, Unknown
  Kingdom: Fungi, Phylum: Ascomycota, Class: Dothideomycetes, Order: Pleosporales, Family: Pleosporaceae, Genus: Alternaria
tacctagagttgtaggctttgcctgctatctcttacccatgtcttttgagcaccttatgtttcctcggtgggctcgcccgccgaatggacaaaatttaaaccctttgtagtttgtaatcagcgtctgaaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctttgcgtgtagactcgccttaaaacaattggcagccggcgtattgatttcggagcgcagtacatctcgcgctttgcactcataacggtggcgtccaaaagtacatttttacactcttgacctcggatcaggtagggatacccgctgaacttaagcatatcaataagcggaggaaaagaaaccaacagggattgccctagtaacggcgagtgaagcggcaacagctcaaatttgaaatctggcgtctttggcgtccgagttgtaatttgcagagggcgctttggcattggcagcggtccaagttccttggaacaggacgtcacagagggtgagaatcccgtacgtggtcgctagcctttaccgtgtaaagccccttcgacgagtcgagttgtttgggaatgcagctctaaatgggaggtaaatttcttctaaagctaaatactggccagagaccgatagcgcacaagtagagtgatcgaaagatgaaaagcactttggaaagagagttaaaaagcacgtgaaattgttgaaagggaagcgcttgcagccagacttgcctgtagttgctcatccgggtttctacccggtgcactcttctacaggcaggccagcatcagtttgggcggttggataaaggtctctgtcatgtacctctcttcggggagaacttataggggagacgacatgcaacca

SEQ ID NO: 631 - DNA, 986 bp, Unknown
  Kingdom: Fungi, Phylum: Ascomycota, Class: Dothideomycetes, Order: Pleosporales, Family: Pleosporales Incertae sedis, Genus: Periconia
accttttcgtttcctcggcaggctcgcctgccaacggggaccccaaaaacgctttgtaatacctgtcattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcctcccctcgcggggggactcgcctcaaaaacattggcggccggtacattggcttcgagcgcagcagaaacgcggtctcgagcccggtggatcggctcccataagcctcttcttttattttgacctcggatcaggtagggatacccgctgaacttaagcatatcaataagcggaggaaaagaaaccaacagggattgccctagtaacggcgagtgaagcggcaacagctcaaatttgaaatctggccctttcagggtccgagttgtaatttgtagagggtgctttggcgttggctgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctacgggcaggccagcatcagtcccagcggttggataaatgcctgttgaatgtacctctcttcggggaggacttatagcctcgggcggcatacaaccagc

SEQ ID NO: 632 - DNA, 255 bp, Preussia intermedia
tacctcttgtttcctcggcgggctcgcccgccgatggaccccccaaaaaacactttgcagtacctgtaatagtctgaacaacaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaa

SEQ ID NO: 633 - DNA, 1042 bp, Unknown
  Kingdom: Fungi, Phylum: Ascomycota, Class: Dothideomycetes, Order: Pleosporales, Family: Sporormiaceae
atcttatcgtagggcttcggccctgtcgagatagaacccttgcctttttgagtacctttcgtttcctcggcaggctcgcctgccaatggggaccacaaaaaacactttgcagtacctgtaacagtctgaacaaacaaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctaagcttggtgttgggtgactgtccgcttcactgcggactcgcctcaaaattattggcggccggtacattggcttcgagcgcagcagaaacgcgaactcgggcccgtcgtattggctcccagaagctatcttcacaattttgacctcggatcaggtagggatacccgctgaacttaagcatatcaataagcggaggaaaagaaaccaacagggattgccctagtaacggcgagtgaagcggcaacagctcaaatttgaaatctggctctttcagggtccgagttgtaatttgtagagggtgctttggagttgactgtggtctaagttccttggaacaggacgtcgcagagggtgagaatcccgtatgtggccgccagtcttctccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctataggcaggccagcatcagtcgcggcggttggataaatgtctgcacaatgtacctctcttcggggaggacttatagggcaggcggcatacaaccagctgcgat

SEQ ID NO: 634 - DNA, 1036 bp, Unknown
  Kingdom: Fungi, Phylum: Ascomycota, Class: Dothideomycetes, Order: Pleosporales, Family: Sporormiaceae, Genus: Preussia
ttgggcttcggcccattcgagataacacccttgcctttttgagtaccttttcgtttcctcggcaggctcgcctgccaacggggaccccaaaaacgctttgtaatacctgtcattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcctcccctcgcggggggactcgcctcaaaaacattggcggccggtacattggcttcgagcgcagcagaaacgcggtctcgagcccggtggatcggctcccataagcctcttcttttattttgacctcggatcaggtagggatacccgctgaacttaagcatatcaataagcggaggaaaagaaaccaacagggattgccctagtaacggcgagtgaagcggcaacagctcaaatttgaaatctggccctttcagggtccgagttgtaatttgtagagggtgctttggcgttggctgtggtctaagttccttggaacaggacgtcgcagagggtgagaatcccgtatgtggccgccagtcttcgccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttgcccggtgcactcttctatgggcaggccagcatcagtcccagcggttggataaatgcctgttgaatgtacctctcttcggggaggacttatagcctcgggcggcatacaaccagccgggat

SEQ ID NO: 635 - DNA, 984 bp, Unknown
  Kingdom: Fungi, Phylum: Ascomycota, Class: Dothideomycetes, Order: Pleosporales, Family: Sporormiaceae, Genus: Preussia
tacctttcgtttcctcggcaggctcgcctgccaatggggaccacaaaaaacactttgcagtacctgtaacagtctgaacaaacaaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctaagcttggtgttgggtgactgtccgcttcactgcggactcgcctcaaaattattggcggccggtacattggcttcgagcgcagcagaaacgcgaactcgggcccgtcgtattggctcccagaagctatcttcacaattttgacctcggatcaggtagggatacccgctgaacttaagcatatcaataagcggaggaaaagaaaccaacagggattgccctagtaacggcgagtgaagcggcaacagctcaaatttgaaatctggctctttcagggtccgagttgtaatttgtagagggtgctttggagttgactgtggtctaagttccttggaacaggacgtcgcagagggtgagaatcccgtatgtggccgccagtcttctccgtgtaaagccccttcgacgagtcgagttgtttgggaatgcagctctaaatgggaggtaaatttcttctaaagctaaatattggccagagaccgatagcgcacaagtagagtgatcgaaagatgaaaagcactttggaaagagagtcaaaaagcacgtgaaattgttgaaagggaagcgcttgcagccagacttgcctgtagttgctcatccgggcttttttgcccggtgcactcttctataggcaggccagcatcagtcgcggcggttggataaatgtctgcacaatgtacctctcttcggggaggacttatagggcaggcggcatacaacca

SEQ ID NO: 636 - DNA, 151 bp, Alternaria 2011
gtaggtgaacctgcggagggatcattacacaaatatgaaggcgggctggaacctctcggggttacagccttgctgaattattcacccttgtcttttgcgtacttcttgtttccttggtgggttcgcccaccactaggacaaacataaacct

SEQ ID NO: 637 - DNA, 151 bp, Unknown
  Kingdom: Fungi, Phylum: , Class: , Order: , Family:
cgtaggtgaacctgcggaagtcgtaccttgaaaacaaaacgacctaagaacgatgaaatatcactctttgtaggccggtttcttactgtgcctgccgattccgtggttatgcgttcatccatgcccaagacatcagttttggttggatcgt

SEQ ID NO: 638 - DNA, 151 bp, Unknown
  Kingdom: Fungi, Phylum: , Class: , Order: , Family:
gtaggtgaacctgcggaaggatcattgtcgaaccctgcaaggcagaacgacccgtgaacatgtaaccacaacggggtgaccgtgataagggcctcggtccttatcccctaacccttcccgacgtgagttcgtggtgtcttttttggggcat

SEQ ID NO: 639 - DNA, 151 bp, Unknown
  Kingdom: Fungi, Phylum: , Class: , Order: , Family:
cgtaggtgaacctgcggaaggatcattgtcgtaccatgaaaacaaaacgacctaagaacgataaaatatcactctttgtaggccggtttcttactgtgcctgccgattccgtggttatgcgttcatccatgcccaagacatcagttttggt

SEQ ID NO: 640 - DNA, 151 bp, Unknown
  Kingdom: Fungi, Phylum: Ascomycota, Class: Sordariomycetes, Order: Hypocreales, Family: Nectriaceae, Genus: Fusarium
gttggtgaaccagcggagggatcattaccgagtttacaactcccaaacccctgtgaacataccaattgttgcctcggcggatcagcccgctcccggtaaaacgggacggcccgccagaggacccctaaactctgtttctatatgtaacttc

SEQ ID NO: 641 - DNA, 151 bp, Lewia infectoria
gtaggtgaacctgcggagggatcattacacaataacaaggcgggctggacacccccagccgggcactgcttcacggcgtgcgcggctgggccggccctgctgaattattcacccgtgtcttttgcgtacttcttgtttcctgggtgggctc

SEQ ID NO: 642 - DNA, 151 bp, Unknown
  Kingdom: Fungi, Phylum: Basidiomycota, Class: , Order: , Family:
gtaggtgaacctgcggaaggatcattgtcgtaccctggaaacagaacgacctgagaacgatgaaacatcactctcggtaggccggtttcttactgtgcctgctgattccgtggttatgcgttcatccttggccaagacttcagttttggtt

SEQ ID NO: 643 - DNA, 151 bp, Rhizopus oryzae
gtaggtgaacctgcggaaggatcattaattatgttaaagcgccttaccttagggtttcctctggggtaagtgattgcttctacactgtgaaaatttggctgagagactcagactggtcatgggtagacctatctggggtttgatcgatgcc

SEQ ID NO: 644 - DNA, 151 bp, Pichia fermentans
gtaggtgaacctgcggaaggatcattactgtgatttatatcttatacacatgcgtgagcgcaccaaacacctaaaattgtaataataccagtcactaagttttaacaaaacaaaactttcaacaacggatctcttggttctcgcatcgatg

SEQ ID NO: 645 - DNA, 151 bp, Unknown
  Kingdom: Fungi, Phylum: Ascomycota, Class: Dothideomycetes, Order: Capnodiales, Family: Davidiellaceae, Genus: Cladosporium
gtaggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactt

SEQ ID NO: 646 - DNA, 151 bp, Aspergillus Aspergillus niger
gtaggtgaacctgcggaaggatcattaccgagtgcgggtcctttgggcccaacctcccatccgtgtctattgtaccctgttgcttcggcgggcccgccgcttgtcggccgccgggggggcgcctctgccccccgggcccgtgcccgccgga

SEQ ID NO: 647 - DNA, 151 bp, Unknown
  Kingdom: Fungi, Phylum: , Class: , Order: , Family:
gtaggtgaacctgcggaaggatcattgtcgtaacctggaaacagaacgacccgagaacgttgaaacatcactctcggtgggccggtttcttagctgatttcgtgcctaccgattccgtggttatgcgttcgtcaccggcccagtttcggtt

SEQ ID NO: 648 - DNA, 151 bp, Davidiella tassiana
gtaggtgaacctgcggagggatcattacaagaacgcccgggcttcggcctggttattcataaccctttgttgtccgactctgttgcctccggggcgaccctgccttcgggcgggggctccgggtggacacttcaaactcttgcgtaacttt

SEQ ID NO: 649 - DNA, 151 bp, Unknown
  Kingdom: Fungi, Phylum: Ascomycota, Class: Leotiomycetes, Order: Helotiales, Family: Helotiaceae
gtaggtgaacctgcggaaggatcattatagtgttcgctgccctcacgggtagcaaacctcacccttgtatatcatatctttgttgctttggcacgccacccccgggtgccggctccggctggctagtgcgtgtcgagggaccgtaaactct

SEQ ID NO: 650 - DNA, 151 bp, Fusarium culmorum
gttggtgaaccagcggagggatcattaccgagtttacaactcccaaacccctgtgaacataccttatgttgcctcggcggatcagcccgcgccccgtaaaaagggacggcccgccgcaggaaccctaaactctgtttttagtggaacttct

SEQ ID NO: 651 - DNA, 151 bp, Phoma P48E5
gtaggtgaacctgcggaaggatcattacctagagttgtaggctttgcctgctatctcttacccatgtcttttgagtaccttacgtttcctcggtgggttcgcccaccgattggacaaatttaaaccctttgcagttgaaatcagcgtctga

SEQ ID NO: 652 - DNA, 151 bp, Penicillium bialowiezense
gtaggtgaacctgcggaaggatcattaccgagtgagggccctctgggtccaacctcccacccgtgtttattttaccttgttgcttcggcgagcctgccttttggctgccgggggacgtctgtccccgggtccgcgctcgccgaagacacct

SEQ ID NO: 653 - DNA, 151 bp, Gibberella intricans
gttggtgaaccagcggagggatcattaccgagtttacaactcccaaacccctgtgaacatacctatacgttgcctcggcggatcagcccgcgccccgtaaaacgggacggcccgcccgaggacccctaaactctgtttttagtggaacttc

SEQ ID NO: 654 - DNA, 151 bp, Unknown
  Kingdom: Fungi, Phylum: Ascomycota, Class: Eurotiomycetes, Order: Eurotiales, Family: Trichocomaceae, Genus: Penicillium
gtaggtgaacctgcggaaggatcattaccgagtgagggccctctgggtccaacctcccacccgtgtttattttaccttgttgcttcggcgggcccgccttaactggccgccggggggctcacgcccccgggcccgcgcccgccgaagacac

SEQ ID NO: 655 - DNA, 151 bp, Phoma macrostoma
gtaggtgaacctgcggaaggatcattacctagagttgcgggctttgcctgccatctcttacccatgtcttttgagtaccttcgtttcctcggtgggttcgcccgccgattggacaaaacttaaaccctttgtaattgaaatcagcgtctga

SEQ ID NO: 656 - DNA, 151 bp, Udeniomyces puniceus
gtaggtgaacctgcggaaggatcactagtgattaaacgggaagcgtcttaactgaccttctcacccttcacatccacatacaccctgtgaactgtttggcttcaactctcgagttgggctctcctatcgatagattagcaatagtctagcg

SEQ ID NO: 657 - DNA, 151 bp, Unknown
  Kingdom: Fungi, Phylum: Ascomycota, Class: Dothideomycetes, Order: Pleosporales, Family: Phaeosphaeriaceae
gtaggtgaacctgcggaaggatcattaaattcagtcgcctgctactgtagggggggtctattagtctgtatagtatcactactgatgggcagcacgaccctctgtctatacccttgtcttttgcgcactcatgtttcctcggcggcttgat

SEQ ID NO: 658 - DNA, 151 bp, Phaeosphaeriaceae MJ23
gtaggtgaacctgcggaaggatcattacattcagtagcttgctactgttagggaggccggttagtctgtatagtatcactactgatgagcagcacggccttctgtctgtacccttgtcttttgcgcactcatgtttcctcggctgggttta

SEQ ID NO: 659 - DNA, 151 bp, Epicoccum nigrum
gtaggtgaacctgcggaaggatcattacctagagtttgtagacttcggtctgctacctcttacccatgtcttttgagtaccttcgtttcctcggcgggtccgcccgccgattggacaacattcaaaccctttgcagttgcaatcagcgtct

SEQ ID NO: 660 - DNA, 151 bp, Cochliobolus homomorphus
gtaggtgaacctgcggagggatcattacacaacaaaatatgaaggcctggcttcgcggccggctgaaatatttttttcacccatgtcttttgcgcacttgttgtttcctgggcgggttcgcccgccaccaggaccaaaccataaacctttt

SEQ ID NO: 661 - DNA, 151 bp, Gibberella intricans
gtaggtgaacctgcggagggatcattaccgagtttacaactcccaaacccctgtgaacatacctatacgttgcctcggcggatcagcccgcgccctgtaaaaagggacggcccgcccgaggaccctaaactctgtttttagtggaacttct

SEQ ID NO: 662 - DNA, 151 bp, Unknown
  Kingdom: Fungi, Phylum: Ascomycota, Class: Sordariomycetes, Order: Hypocreales, Family: Incertae sedis  , Genus: Acremonium
gttggtgaaccagcggagggatcattaccgagtgtaaaaactcccaaaccattgtgaacctaccactgttgcttcggcggcctcgccccgggcgcgttcgcgcggcccggacccaggcgtccgccggaggctccaaactcttgtcttttag

SEQ ID NO: 663 - DNA, 151 bp, Lewia infectoria
gtaggtgaacctgcggagggatcattacacaataaccaggcgggctggacaccccccgctgggcactgcttcacggcgtgcgcggcggggccggccctgctgaattattcacccgtgtcttttgcgtacttcttgtttcctgggggggctc

SEQ ID NO: 664 - DNA, 151 bp, Unknown
  Kingdom: Fungi, Phylum: Ascomycota, Class: Eurotiomycetes, Order: Eurotiales, Family: Trichocomaceae, Genus: Eurotium (Aspergillus)
gtaggtgaacctgcggaaggatcattaccgagtgcgggccctctgggtccaacctcccatccgtgtctatctgtaccctgttgcttcggcgtggccacggcccgccgaagactaacatttgaacactgtctgaagtttgcagtctgagttt

SEQ ID NO: 665 - DNA, 151 bp, Unknown
  Kingdom: Fungi, Phylum: Basidiomycota, Class: Tremellomycetes, Order: Tremellales, Family: Tremellaceae, Genus: Cryptococcus (Filobasidiella)
gtaggtgaacctgcggaaggatcattaatgaatttagattgaaccataggcgaaagccagtggttcttctttcatatccataacacctgtgcactgttggatgcttgcatccacttttaaactaaacattattgtaacaaatgtagtctta

SEQ ID NO: 666 - DNA, 151 bp, Cladosporium ascomyc1
gtaggtgaacctgcggagggatcattatatgacgccccaggcttgtacagctgggaacgcacaaccctttgttttccgactctgttgcctccggggcgaccctgccttcgggcgggggctccgggtggacacttcaaactcttgcgtaact

SEQ ID NO: 667 - DNA, 151 bp, Unknown
  Kingdom: Fungi, Phylum: Ascomycota, Class: , Order: , Family:
gtaggtgaacctgcggaaggatcattgtcgaaacctgcctagcagaacgacccgtgaacaagttaaaacagctggtcttttagggcttgaaacatttgttttgagccttatgaggccttgtcgacgtgtgttcatggttgcccatggggca

SEQ ID NO: 668 - DNA, 151 bp, Unknown
  Kingdom: Fungi, Phylum: , Class: , Order: , Family:
cgtaggtgaacctgcggaaggatcattgtcgtaccctgaaaacaaaacgacataagaacgatgaaatatcactctttgttggccggtttcttactgtgcttgccgattccgtggttatgcgttcatccatgcccaagacatcagttttggt

SEQ ID NO: 669 - DNA, 151 bp, Phoma rhei
gtaggtgaacctgcggaaggatcattacctagagttgtaggctttgcctgctatctcttacccatgtcttttgagtaccttcgtttcctcggcgggtccgcccgccgattggacaatttaaaccatttgcagttgcaatcagcgtctgaaa

SEQ ID NO: 670 - DNA, 151 bp, Monographella cucumerina
gttggtgaaccagcggagggatcattactgagtactacactctctaccctttgtgaactattatacctgttgcttcggcggcgcccgcaagggtgcccgccggtctcatcagaatctctgttttcgaacccgacgatacttctgagtgttc

SEQ ID NO: 671 - DNA, 151 bp, Phaeosphaeriaceae MJ23
gtaggtgaacctgcggaaggatcattaaattcagtagcttgctactgttaggggggtctattagtctgtatagtatcactactgatgagcagcacgaccctctgtctatacccttgtcttttgcgcactcatgtttcctcggcggctttat

SEQ ID NO: 672 - DNA, 151 bp, Unknown
  Kingdom: Fungi, Phylum: , Class: , Order: , Family:
gtaggtgaacctgcggagggatcattgtcgtacccttgaaacagaacgacctgagaacgatgaaacatcactctcggtaggtcggtttcttactgtgcctgccgattccgtggttatgcgttcatccatacccaagacttcagttttggtt

SEQ ID NO: 673 - DNA, 151 bp, Unknown
  Kingdom: Fungi, Phylum: Ascomycota, Class: Dothideomycetes, Order: Pleosporales, Family: Pleosporaceae
gtaggtgaacctgcggagggatcattacacaatatgaaagcgggctggcatccttcggggttacagccttgctgaattattcacccgtgtcttttgcgtacttcttgtttccttggtgggttcgcccaccataggacaaaccataaacctt

SEQ ID NO: 674 - DNA, 151 bp, Unknown
  Kingdom: Fungi, Phylum: Basidiomycota, Class: , Order: , Family:
gtaggtgaacctgcggaaggatcattgtcgtatcctggaaacagaacgacctgagaacgatgaaacatcactctcggtaggccggttttttactgtgcttgtcgattccgttgttatgcgttcatccatgcccaagactccagttttggtt

SEQ ID NO: 675 - DNA, 151 bp, Unknown
  Kingdom: Fungi, Phylum: , Class: , Order: , Family:
gtaggtgaacctgcggagggatcattgtcgtacccttgaaacagaacgccctgagaacgacgaaacatcactctcggtcggccggtttcttactgtgcctgccgattccgtggttatgcgttcatccatgcccaagacttcagttttggtt

SEQ ID NO: 676 - DNA, 151 bp, Erysiphe cruciferarum
gtaggtgaacctgcggaaggatcattacagagtgcgaggctcagtcgtggcgtctgctgcgtgctgggccgaccctcccacccgtgtcgatttgtatcttgttgctttggcgggccgggccgcgtcgtcgctgcccgcatgggacatgcgt

SEQ ID NO: 677 - DNA, 151 bp, Unknown
  Kingdom: Fungi, Phylum: Ascomycota, Class: Sordariomycetes, Order: Hypocreales, Family: Nectriaceae, Genus: Gibberella
gttggtgaaccagcggagggatcattaccgagtttacaactcccaaacccctgtgaacataccttaatgttgcctcggcggatcagcccgcgccccgtaaaacgggacggcccgccagaggacccaaactctaatgtttcttattgtaact

SEQ ID NO: 678 - DNA, 151 bp, Wallemia muriae
gtaggtgaacctgcggaaggatcattagtgattaattattgagtgtaaaaaactcataatcttctacaaaccactgttttaaatgtttactagaatgtccaagcagttaagctgttgaaatattaaaagttttataaaactttcagcaacg

SEQ ID NO: 679 - DNA, 151 bp, Sporobolomyces ruberrimus
gtaggtgaacctgcggaaggatcattattgaaaacaagggtgtccaatttaacttggaacccgaacttctcaattctaactttgtgcatctgtattatggcgagcagtcttcggattgtgagccttcacttataaacactagtctatgaat

SEQ ID NO: 680 - DNA, 151 bp, Penicillium bialowiezense
gtaggtgaacctgcggaaggatcattaccgagtgagggccctctggtccaacctcccacccgtgtttatttaccttgttgcttcggcgagcctgccttttggctgccgggggacgtcagtccccgggtccgtgctcgccggagacacctta

SEQ ID NO: 681 - DNA, 151 bp, Aspergillus flavus
gtaggtgaacctgcggaaggatcattaccgagtgtagggttcctagcgagcccaacctcccacccgtgtttactgtaccttagttgcttcggcgggcccgccattcatggccgccgggggctctcagccccgggcccgcgcccgccggaga

SEQ ID NO: 682 - DNA, 151 bp, Unknown
  Kingdom: Fungi, Phylum: Ascomycota, Class: Dothideomycetes, Order: Dothideales, Family: Dothioraceae, Genus: Aureobasidium
gtaggtgaacctgcggaaggatcattaaagagtaagggtgctcagcgcccgacctccaaccctttgttgttaaaactaccttgttgctttggcgggaccgctcggtctcgagccgctggggattcgtcccaggcgagcgcccgccagagtt

SEQ ID NO: 683 - DNA, 151 bp, Unknown
  Kingdom: Fungi, Phylum: Basidiomycota, Class: , Order: , Family:
gtaggtgaacctgcggaaggatcattgttgtaccctggaaacagaacgacctaagaacgatgaaacatcactctcggtaggccggtttcttactgtgcctgccgattccgtggttatgcgttcatccatgcccaagacatcagttttggtt

SEQ ID NO: 684 - DNA, 151 bp, Cladosporium ascomyc1
gtaggtgaacctgcggagggatcattataagttcacccaggcttgtacagctggggactgacaaccctttgatttccgactctgttgcctccggggcgaccctgccttcgggcgggggctccgggtggacacttcaaactcttgcgtaact

SEQ ID NO: 685 - DNA, 151 bp, Unknown
  Kingdom: Fungi, Phylum: Ascomycota, Class: Dothideomycetes, Order: Pleosporales, Family: Pleosporaceae
gtaggtgaacctgcggagggatcattacacaatatgaaagcgggttgggacctcacctcggtgagggctccagcttgtctgaattattcacccatgtcttttgcgcacttcttgtttcctgggcgggttcgcccgccaccaggaccaaacc

SEQ ID NO: 686 - DNA, 151 bp, Cryptococcus victoriae
gtaggtgaacctgcggaaggatcattaatagtgccctttgatgcaaatcattgggttagatctgctctcttcgcaagaagagggtttccatacacaccgtgaactgtggcttcggccatcacaaactgttagtaatgaatgtaatatcata

SEQ ID NO: 687 - DNA, 151 bp, Unknown
  Kingdom: Fungi, Phylum: Basidiomycota, Class: Tremellomycetes, Order: Filobasidiales, Family: Filobasidiaceae, Genus: Cryptococcus
gtaggtgaacctgcggaaggatcattaatgaataaaggtatcacgcctcacggctgtgtgttggatcattgtgcaatagtctttgatccacttcctatcatatccataacacctgtgcactgttggatgcttgcatccacttttaaactaa

SEQ ID NO: 688 - DNA, 151 bp, Parastagonospora caricis
gtaggtgaacctgcggaaggatcattacactcagtcgtttactactgtcaaaggggctgttagtctgtatagcgcaagctgatgagcagctggcctcttttatccacccttgtcttttgcgtacccacgtttcctcggcaggcttgcctgc

SEQ ID NO: 689 - DNA, 151 bp, Penicillium citrinum
gtaggtgaacctgcggaaggatcattaccgagtgcgggcccctcggggcccaacctcccacccgtgttgcccgaacctatgttgcctcggcgggccccgcgcccgccgacggcccccctgaacgctgtctgaagttgcagtctgagaccta

SEQ ID NO: 690 - DNA, 151 bp, Unknown
  Kingdom: Fungi, Phylum: , Class: , Order: , Family:
cgtaggtgaacctgcggaaggatcattgtcgtaccatgaaaccaaaacgacctaagaacgatgaaatatcactctttgtaggccggtttcttactgtgcctgctgattccgtggttgtgcgttcatccatgcccaagacttcagttttggt

SEQ ID NO: 691 - DNA, 151 bp, Cryptococcus albidus
gtaggtgaacctgcggaaggatcattaatgattaactgtctgtcgagcttgctcacagacttatcatatccataacacctgtgcacttgtcggatggcttagtgaagaccgcaaggttggaactatccatctactttacataacaatttag

SEQ ID NO: 692 - DNA, 151 bp, Cladosporium 234B
gtaggtgaacctgcggagggatcattacaagtgaccccggctacggccgggatgttcataaccctttgttgtccgactctgttgcctccggggcgaccctgccttcgggcgggggctccgggtggacacttcaaactcttgcgtaactttg

SEQ ID NO: 693 - DNA, 151 bp, Cryptococcus albidus
gtaggtgaacctgcggaaggatcattaatgattgaacgtctgtcgagcttgctcacaggcacatcatatccataacacctgtgcacttgtcggatggcttagtgaagaccgcaaggttggatctatccatctactttacataacaattctg

SEQ ID NO: 694 - DNA, 151 bp, Unknown
  Kingdom: Fungi, Phylum: Ascomycota, Class: Dothideomycetes, Order: Capnodiales, Family: Davidiellaceae, Genus: Cladosporium
gtaggtgaacctgcggagggatcattacaagtgacccccggctccggccggggatgttcataaccctttgttgtccgactctgttgcctccggggcgaccctgccttttcacgggcgggggccccgggtggacacatcaaaactcttgcgt

SEQ ID NO: 695 - DNA, 151 bp, Unknown
  Kingdom: Fungi, Phylum: Basidiomycota, Class: Tremellomycetes, Order: Filobasidiales, Family: Filobasidiaceae, Genus: Cryptococcus
gtaggtgaacctgcggaaggatcattattgaattcaaatcatctgtggcttcggtccggatgtgccaacaggtaacactgttggtaattctatccataacacctgtgaactgttggatgcttgcatccacttttatactaaacattattgt

SEQ ID NO: 696 - DNA, 151 bp, Hannaella luteola
gtaggtgaacctgcggaaggatcattattaaacgttacttcggtaacttaatatccttaacacctgtgcatcttgtcgctccggcgatattatacaaacatcagtgtaaagaatgtattatattataacaaatacaactttcaacaacgga

SEQ ID NO: 697 - DNA, 151 bp, Unknown
  Kingdom: Fungi, Phylum: Ascomycota, Class: Dothideomycetes, Order: , Family:
gtaggtgaacctgcggaaggatcattaaatgaaaagctggtttaccagtatacggcccctgggtttgtttctgacaagcgccaggatcagtcgtcatttatacccatgttttttgcgtactacttgtttccttggtaggcttgcctaccat

SEQ ID NO: 698 - DNA, 151 bp, Rhodosporidium diobovatum
gtaggtgaacctgcggaaggatcattagtgaatctaggacgtccaacttaacttggagtccgaactctcactttctaaccctgtgcatctgttaattggaatagtagctcttcggagtgaaccaccattcacttataaaacacaaagtcta

SEQ ID NO: 699 - DNA, 151 bp, Unknown
  Kingdom: Fungi, Phylum: Ascomycota, Class: Dothideomycetes, Order: Pleosporales, Family: Phaeosphaeriaceae
gtaggtgaacctgcggaaggatcattacattcagtagcctagctacttgtttatacccttgttttttgcgtacctattgtttcctcggtgggcttgcctgccggttggacaacactataacctttttaaatcttcaatcagcgtctgaatt

SEQ ID NO: 700 - DNA, 151 bp, Unknown
  Kingdom: Fungi, Phylum: Ascomycota, Class: Dothideomycetes, Order: Pleosporales, Family: Phaeosphaeriaceae
gtaggtgaacctgcggaaggatcattacaattcagtagcttgctactgtcgggaggcgctgtaagtccgcatagtttaattactgatgagcggcaggccctctgtctgtacccttgtcttttgcgcactcatgtttcctcggcgggcttgc

SEQ ID NO: 701 - DNA, 151 bp, Sporobolomyces roseus
gtaggtgaacctgcggaaggatcattagtgaataaatagggtgtccaatttaacttggaacccgaccttctcacatctaaccctgtgcatctgtattaatggcgagcaattttcggattgtgagccatttcactttataaacactagtcta

SEQ ID NO: 702 - DNA, 151 bp, Unknown
  Kingdom: Fungi, Phylum: Ascomycota, Class: Dothideomycetes, Order: Pleosporales, Family: Leptosphaeriaceae, Genus: Epicoccum
gtaggtgaacctgcggaaggatcattacctagagtttgtggacttcggtctgctacctcttacccatgtcttttgagtaccttcgtttcctcggcgggtccgcccgccgggtggacaacattcaaacccttttcagtttcaatcagcgtct

SEQ ID NO: 703 - DNA, 151 bp, Sporobolomyces oryzicola
gtaggtgaacctgcggaaggatcattaatgaaattcaaggacgctctttttagaggtccgaccaattacattttacctttactctgtgcacacactactctttacaccattttttaactctatagttttaagaatgtaaaacaagtctcga

SEQ ID NO: 704 - DNA, 151 bp, Unknown
  Kingdom: Fungi, Phylum: , Class: , Order: , Family:
gtaggtgaacctgcggagggatcattgtcgtacccttaaaacagaacgacctgagaacgacgaaacatcactcttggtaggccggtttcttactgtgcctaccgattccgtggttatgcgttcatccatgcccaagacttcagttttggtt

SEQ ID NO: 705 - DNA, 151 bp, Botrytis CID95
gtaggtgaacctgcggaaggatcattacagagttcatgcccgaaagggtagacctcccacccttgtgtattattactttgttgctttggcgagctgcctttgggccttgtatgctcgccagagaataccaaaactctttttattaatgtcg

SEQ ID NO: 706 - DNA, 151 bp, Wallemia sebi
gtaggtgaacctgcggaaggattattagtgattaattattgagtgtagaaactcataatcttctatacaaaccactgttttaaaatgtttactagaatgtccaaacagttaagctgttgaaattataaaagtttaataaaactttcagcaa

SEQ ID NO: 707 - DNA, 151 bp, Wallemia sebi
gtaggtgaacctgcggaaggatcattagtgattaattattgagtgtaaaaaactcataatcttctatacaaaccactgttttaaaatgtttactagaatgtccaagcagttaagctgttgaaatattaaaagtttaataaaactttcagca

SEQ ID NO: 708 - DNA, 151 bp, Unknown
  Kingdom: Fungi, Phylum: Basidiomycota, Class: Tremellomycetes, Order: , Family:
gtaggtgaacctgcggaaggatcactaaggtaaacgccctccggggctctctttattcacacacccctgtgcactttggccacctgccgcgcttaactgcgttagtaggtgtgtctctttatttatacccatatacacaagtcattgaatg

SEQ ID NO: 709 - DNA, 151 bp, Cercospora nicotianae
gtaggtgaacctgcggagggatcattactgagtgagggccttcgggctcgacctccaaccctttgtgaacacaacttgttgcttcgggggcgaccctgccgtttcgacggcgagcgcccccggaggccttcaaacactgcatctttgcgtc

SEQ ID NO: 710 - DNA, 151 bp, Unknown
  Kingdom: Fungi, Phylum: Ascomycota, Class: Dothideomycetes, Order: Pleosporales, Family: Incertae sedis  , Genus: Phoma
gtaggtgaacctgcggaaggatcattacctagagttgtaggctttgcctaccatctcttacccatgtcttttgagtaccttcgtttcctcggcgggtccgcccgccgattggacaaacttaaaccctttgtaattgaaatcagcgtctgaa

SEQ ID NO: 711 - DNA, 151 bp, Phoma paspali
gtaggtgaacctgcggaaggatcattaccgagagttgtaggcttctgtctaccatctcttacccatgtcttttgcgtactacacgtttcctcggcaggtccgcctgccgctaggacaatttaaaccatttgcagttgcagtcagcgtctga

SEQ ID NO: 712 - DNA, 151 bp, Unknown
  Kingdom: Fungi, Phylum: Basidiomycota, Class: Tremellomycetes, Order: Tremellales, Family: Incertae sedis  , Genus: Hannaella
gtaggtgaacctgcggaaggatcattattaaatgttactccggtaactttataatcccttaacacctgtgcattttgtcgcttcggcgatattatacaaacatcagtgtaatgaatgtaaattattataacaaatacaactttcaacaacg

SEQ ID NO: 713 - DNA, 151 bp, Wallemia sebi
gtaggtgaacctgcggaaggatcattagtgattaattattgagtgtaaaaactcataatcttctattacaaaccactgttttaaaatgtttactagaatgtccaagcagttaagctgttaaaattataaaagtttaataaaactttcagca

SEQ ID NO: 714 - DNA, 151 bp, Unknown
  Kingdom: Fungi, Phylum: Basidiomycota, Class: Tremellomycetes, Order: , Family:
gtaggtgaacctgcggaaggatcactaaagtaaacgccctccggggctctctttattcacacacccctgtgcactttggccacctgccgcgcttcactgcgttagtaggtgtgtctttataattatacccatatacacaagtcattgaatg

SEQ ID NO: 715 - DNA, 151 bp, Phaeosphaeriaceae MJ23
gtaggtgaacctgcggaaggatcattaaattcagtagcttgctactgttaaggagggtctattagtctgtatagtatcactactgatgagcagcacgaccctctgtctatactcttgtcttttgcgcactcatgtttcctcggcggctcga

SEQ ID NO: 716 - DNA, 151 bp, Stagonospora SRC1lsM3a
gtaggtgaacctgcggaaggatcattacattcagtagcctagctacttgtttacacccttgtttttgcgtacctattgtttcctcggcgggcttgctcgccggttggacaaaactataaccttttttaaatcttcaatcagcgtctgaatt

SEQ ID NO: 717 - DNA, 151 bp, Bullera unica
gtaggtgaacctgcggaaggatcattagtgattgacctccgggtcttaataactataatcttctacctctgtgaaccgttggtcttcggaccgattcttataacaaacatctgtgtaatgaacgtaacctatattaatcatataaaacttt

SEQ ID NO: 718 - DNA, 151 bp, Unknown
  Kingdom: Fungi, Phylum: Basidiomycota, Class: Tremellomycetes, Order: Tremellales, Family:
gtaggtgaacctgcggaaggatcattaatgattgaccctctgggtcttatcttaacatccctcacctctgtgaaccgtttgacctccgggtcttacaaaaaccataacaaacatcagtgtaaagaacgtcttgttatcttaacaaaaacaa

SEQ ID NO: 719 - DNA, 151 bp, Cryptococcus paraflavus
gtaggtgaacctgcggaaggatcattagtgaacgccctcacgggcttaactatccaaccaacctctgtgaaccgtcgccctcgggcgcttataacaaactataacagtcatgaacgtagtatacaaaaactaaacacaactttcaacaacg

SEQ ID NO: 720 - DNA, 151 bp, Cryptococcus oeirensis
gtaggtgaacctgcggaaggatcattaatgaattttacgccctagtcttaactgataggggctggttctatccataacacctgtgcactgttggatgcttgcatccacttttaaactaaacattattgtaacaaatgtagtcttattataa

SEQ ID NO: 721 - DNA, 151 bp, Cryptococcus wieringae
gtaggtgaacctgcggaaggatcattaatgaaaatgtgttgccggggcccataatcccggcactaaccttcttatccataacacctgtgcactgttggatgcttgcatccacttttatactaaacaatttgtaacaaatgtagtcttatta

SEQ ID NO: 722 - DNA, 151 bp, Unknown
  Kingdom: Fungi, Phylum: Basidiomycota, Class: Tremellomycetes, Order: Tremellales, Family: Incertae sedis , Genus: Cryptococcus
gtaggtgaacctgcggaaggatcattattgattggtcgaaagaccttatcagattctaccacctctgtgaactgttggacctccgggtctacaatcaaacatcagtgtaacgaacgtaagagtatcttaacgaaacaaaactttcaacaac

SEQ ID NO: 723 - DNA, 151 bp, Unknown
  Kingdom: Fungi, Phylum: Ascomycota, Class: Dothideomycetes, Order: Pleosporales, Family:
gtaggtgaacctgcggaaggatcattaacctttcaaatcagggtgcggcgcggcccccgaggagcggaaacaatccttgggaggtatgcgggggcttcgagccccccatttacgcacgcacgactgccatccttactttacgagcaccttc

SEQ ID NO: 724 - DNA, 151 bp, Cryptococcus laurentii
gtaggtgaacctgcggaaggatcattattgattggtcgaaagaccttatcagattctaccacctctgtgaaccgttgacctccgggttaataatcaaacatcagtgtaacgaacgtaagagtatcttaattaaacaaaacttttaacaacg

SEQ ID NO: 725 - DNA, 151 bp, Unknown
  Kingdom: Fungi, Phylum: , Class: , Order: , Family:
gtaggtgaacctgcggaaggatcattgtcataccctggaaacagaacgacctgagaacgatgaaacatcactctcggtaggccggtttcttactgtgcctgccgattccgtggttatgcgtacatccatgcccaagacttcagctttggtt

SEQ ID NO: 726 - DNA, 151 bp, Unknown
  Kingdom: Fungi, Phylum: Basidiomycota, Class: Tremellomycetes, Order: Tremellales, Family:
gtaggtgaacctgcggaaggatcattaacaaagttcgcttctctgaagcaactgatctctaacacctgtgcatcttgtcgctccggcgatatatcaaacatcagtgtaaagaatgtaatttattataacaaatacaactttcaacaacgga

SEQ ID NO: 727 - DNA, 151 bp, Unknown
  Kingdom: Fungi, Phylum: Basidiomycota, Class: , Order: , Family:
cgtaggtgaacctgcggaaggatcattgtcgtaccatgaaaacaaaacgacctaagaacgatgaaatatcactctctgtaggccggtttcttactgtgcctgctgattccgtggttatgcgttcatccttggccaagacttcagttttggt

SEQ ID NO: 728 - DNA, 151 bp, Unknown
  Kingdom: Fungi, Phylum: Ascomycota, Class: Dothideomycetes, Order: Pleosporales, Family: Incertae sedis  , Genus: Phoma
gtaggtgaacctgcggaaggatcattacctagagttgcgggctttgcctgctatctcttacccatgtcttttgagtacttacgtttcctcggcgggtccgcccgccgaagacaaactataaaacctttgcagttgcaatcagcgtctgaac

SEQ ID NO: 729 - DNA, 151 bp, Unknown
  Kingdom: Fungi, Phylum: Basidiomycota, Class: Tremellomycetes, Order: Filobasidiales, Family: Filobasidiaceae, Genus: Cryptococcus
gtaggtgaacctgcggaaggatcattaatgaataaaggaccaccgcctcacggcttggttgttggatcattgtgcaatagtctttgatccactttcctatcatatccataacacctgtgcactgttggatgcttgcatccacttttaaact

SEQ ID NO: 730 - DNA, 151 bp, Cryptococcus victoriae
gtaggtgaacctgcggaaggatcattaatagtgctcattgacgcaagtcagtgagttagatctgctctcttcgcaagaagagggtttccatacacaccgtgaactgtggcttcggccatcacaaactgttagtaatgaatgtaatatcata

SEQ ID NO: 731 - DNA, 151 bp, Sporobolomyces roseus
gtaggtgaacctgcggaaggatcattagtgaataaatagggtgtccaatttaacttggaacccgaccttctcacatccaaccctgtgcatctgtatttaacggcgagcaatttccgaattgtgagccatttcactttataaacactagtct

SEQ ID NO: 732 - DNA, 151 bp, Unknown
  Kingdom: Fungi, Phylum: , Class: , Order: , Family:
gtaggtgaacctgcagaaggatcattgtcgtaccctggaaacagaacgacctgagaatgatgaaacatcactctcggtaggccggtttcttattgtgcctaccgattccgtggttatgcgttcatccatgcccaagacttcaattttggtt

SEQ ID NO: 733 - DNA, 151 bp, Unknown
  Kingdom: Fungi, Phylum: Ascomycota, Class: Dothideomycetes, Order: Pleosporales, Family: Phaeosphaeriaceae
gtaggtgaacctgcggaaggatcattacattcagtcgcctagctacttgtttacacccttgtttttttgcgtacctattgtttcctcggtgggcttgcctgccggttggacaaaacctataacctttttaaatcttcaatcagcgtctgaa

SEQ ID NO: 734 - DNA, 151 bp, Acremonium 2010l
gttggtgaaccagcggagggatcattaccagagtgccctaggctctccaacccattgtgaacttaccaaacgttccctcggcgggctcagcgcgcggtggcctccgggcctccgggcgtccgccggggaaaaccaaaccctgatttaatcg

SEQ ID NO: 735 - DNA, 151 bp, Unknown
  Kingdom: Fungi, Phylum: Basidiomycota, Class: , Order: , Family:
cgtaggtgaacctgcggaaggatcattgtcgtaccctgaaaccaaaacgacctaagaacgctgaaatatccctctttgtaggccggtttcttactgtgcctgccgattccgtggttatgcgttcatccatgcccaagacatcagttttggt

SEQ ID NO: 736 - DNA, 151 bp, Unknown
  Kingdom: Fungi, Phylum: , Class: , Order: , Family:
gtaggtgaacctgcggaaggatcattgtggtaccctggaaacagaatgacctgagaacgatgaaacatcactctcggtaggccggtttcttactgtgcctgccgattccgtggttatccatgcccaagacttcagttttggttggatcgta

SEQ ID NO: 737 - DNA, 151 bp, Cryptococcus 2009b
gtaggtgaacctgcggaaggatcattagtgaattgagctggcttcggccgctctgatctatacacacctgtgaactgttggccttcgggtctttaattacaactgtgacgaacgtaaattattataacaaataaaacttttaacaacggat

SEQ ID NO: 738 - DNA, 151 bp, Unknown
  Kingdom: Fungi, Phylum: , Class: , Order: , Family:
gtaggtgaacatgcggaaggatcattttcgttccctaaaacatcactctcggtaggccggtttcttactgtgcctgccaattccgtggttatgcgttcatccatgcccaagacttcagttttggttggatcgtacacatagcttccaaata

SEQ ID NO: 739 - DNA, 151 bp, Unknown
  Kingdom: Fungi, Phylum: Ascomycota, Class: Dothideomycetes, Order: Pleosporales, Family:
gtaggtgaacctgcggaaggatcattacaatcagtagatttctactgctgagagagagcggaaagtagtcagctgcccctggtagtctggctacaagtacgttctctgtctgtacccttgtctttttgcgcactcatgtttcctcggcggg

SEQ ID NO: 740 - DNA, 151 bp, Unknown
  Kingdom: Fungi, Phylum: Basidiomycota, Class: Tremellomycetes, Order: Tremellales, Family: Incertae sedis , Genus: Hannaella
gtaggtgaacctgcggaaggatcattattaaatgcgaagccatcactggcctagctttataatcccttattacacctgtgcaccttattgtctttggacaattttaacaaacatcagtgtaaagaatgtaaactattataataaatacaac

SEQ ID NO: 741 - DNA, 151 bp, Sporobolomyces symmetricus
gtaggtgaacctgcggaaggatcattaatgaaatgcaaggacgctctttttagaggtccgaccaactcatttacctttacactgtgcacatactacttttttacaccaattttttaacgcattagtttaagaatgtaaaatcagtctcgaa

SEQ ID NO: 742 - DNA, 151 bp, Leptospora symmetricus
gtaggtgaacctgcggaaggatcattatgaatcagtagcttgctactgcgctgggggagatgggaaagtcctggctgaaaagtcggtgtactggtacctgcacccctatcatatccttgtcttttgagtacttatgtttccttggtaggct

SEQ ID NO: 743 - DNA, 151 bp, Unknown
  Kingdom: Fungi, Phylum: Ascomycota, Class: Dothideomycetes, Order: Pleosporales, Family: Leptosphaeriaceae, Genus: Epicoccum
gtaggtgaacctgcggaaggatcatcacctagagtttgtggacttcggtctgctacctcttacccatgtcttttgagtaccttcggttcctcggcgggtccgcccgccggttggacaacattcaaaccctttgcagttgcaatccgcgtct

SEQ ID NO: 744 - DNA, 151 bp, Aspergillus r130
gtaggtgaacctgcggaaggatcattaccgagtgcgggctgcctccgggcgcccaacctcccacccgtgactacctaacactgttgcttcggcggggagccctttcgggggcgagccgccggggactactgaacttcatgcctgagagtga

SEQ ID NO: 745 - DNA, 151 bp, Dioszegia hungarica
gtaggtgaacctgcggaaggatcattaataaatggcgaagctttcgagcctagcttttatcatcctatacacctgtgaactatttgccttcgggcaccaaacaaacataatgtaatgaatgtaatctactataataaatacaactttcaac

SEQ ID NO: 746 - DNA, 151 bp, Unknown
  Kingdom: Fungi, Phylum: Basidiomycota, Class: Tremellomycetes, Order: Tremellales, Family:
gtaggtgaacctgcggaaggatcattaataatgccctctgacttcggtcagctgggttcaaatgagtgccttctcttcggagttggccatcctcacacaccgtgaactgtggcttcggccatcacaaactgttagtaatgaatgtaatatc

SEQ ID NO: 747 - DNA, 151 bp, Sporobolomyces ruberrimus
gtaggtgaacctgcggaaggatcattattgaaaacaagggtgtccaatttaacttggaacccaaacttctcaattctaactttgtgcatctgtattaatggcgagcaacttcggttgtgagccttcacttacaaaacactagtctatgaat

SEQ ID NO: 748 - DNA, 151 bp, Phoma paspali
gtaggtgaacctgcggaaggatcattaccgagagttgtaggcttctgtctaccatctcttacccatgtcttttgcgtacttaacgtttcctcggcaggtccgcctgccgtaggacaattataaaccatttgcagttgcagtcagcgtctga

SEQ ID NO: 749 - DNA, 151 bp, Unknown
  Kingdom: Fungi, Phylum: Basidiomycota, Class: Tremellomycetes, Order: Filobasidiales, Family: Filobasidiaceae, Genus: Cryptococcus
gtaggtgaacctgcggaaggatcattaatgaatcacggtacacgcctcacggctgtgttgttggatcattgtgcaatagtctttgatccacttccctatcatatccataacacctgtgcactgttggatgcttgcatccacttttaaacta

SEQ ID NO: 750 - DNA, 151 bp, Cryptococcus victoriae
gtaggtgaacctgcggaaggatcattaatagtgctctctgatgcaaatcattgagttagatctgctctcctcgcaagaggagggtttccatacacaccgtgaattgtggcttcggccatcacaaactgttagtaatgaatgtaatatcata

SEQ ID NO: 751 - DNA, 151 bp, Unknown
  Kingdom: Fungi, Phylum: Ascomycota, Class: Dothideomycetes, Order: Pleosporales, Family: Leptosphaeriaceae, Genus: Epicoccum
gtaggtgaacctgcggaaggatcattaccaagagtttgtggacttcggtctgctacctcttacccatgtcttttgagtaccttcgtttcctcggcgggtccgcccgccggttggacaccattcaaaccctttgcagttacaatcagcgtct

SEQ ID NO: 752 - DNA, 151 bp, Dioszegia athyri
gtaggtgaacctgcggaaggatcattaataaatggcgaagctcgaaagagtctaagctttatattattccataacacctgtgaactatttgccttcttgtcatgagaaggtacaacctatacaaacataactgtaatgaatgtaatctatt

SEQ ID NO: 753 - DNA, 151 bp, Incertae sedis TG05
gtaggtgaacctgcggaaggatcattaataatgctctctggcttcggtcagttgagttcaatgagtgccttctcttcggagttggccatccacacacaccgtgaactgtggcttcggccatcacaaactgttagtaatgaatgtaatatca

SEQ ID NO: 754 - DNA, 151 bp, Bullera globospora
gtaggtgaacctgcggaaggatcattattgaatttgatcttcggatctcatacataataacacactgtgaaccgtggcttcggcccaaacttgaagtctagaatgtaatatatcataataaaatacaacttttaacaacggatctcttggc

SEQ ID NO: 755 - DNA, 151 bp, Erythrobasidium hasegawianum
gtaggtgaacctgcggaaggatcattaatgaatttttagggcgctctctttagaggtccgaccaatttcatttccacacactgtgaacacacttcattttacacacaatttataaacacacaagtctataagaatgtttaaagtctcttaa

SEQ ID NO: 756 - DNA, 612 bp, Unknown
  Kingdom: Fungi, Phylum: Zygomycota, Class: Mucoromycotina, Order: Mucorales, Family: Mucoraceae, Genus: Mucor
  misc_feature (605)..(606): n is a, c, g, or t
cattaaataatcaataatcttggctatgtccattattatctatttactgtgaactgtattattatttgacatttgagggatgttccaatgttataaggatagacattggaaatgttaaccgagtcataatcaggtttaggcctggtatcctattattatttaccaaatgaattcagaattaatattgtaacatagacctaaaaaatctataaaacaacttttaacaacggatctcttggttctcgcatcgatgaagaacgtagcaaagtgcgataactagtgtgaattgcatattcagtgaatcatcgagtctttgaacgcaacttgcgctcattggtattccaatgagcacgcctgtttcagtatcaaaacaaaccctctattcaacttttgttgtataggattattgggggcctctcgatctgtatagatcttgaaatccttgaaatttactaaggcctgaacttgtttaaatgcctgaacttttttttaatataaaggaaagctcttgtaattgactttgatggggcctcccaaataaatctcttttaaatttgatctgaaatcaggcgggattacccgctgaacttaagcatatcaataannggagga

SEQ ID NO: 757 - DNA, 553 bp, Unknown
  Kingdom: Fungi, Phylum: Ascomycota, Class: Dothideomycetes, Order: Capnodiales, Family: Davidiellaceae, Genus: Cladosporium
agtaaaagtcgtaacaaggtctccgtaggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaag

SEQ ID NO: 758 - DNA, 600 bp, Unknown
  Kingdom: Fungi, Phylum: Ascomycota, Class: Sordariomycetes, Order: Xylariales, Family: Amphisphaeriaceae, Genus: Pestalotiopsis
tggtgaccagcggagggatcattatagagttttctaaactcccaacccatgtgaacttaccattgttgcctcggcagaagctacctggttaccttaccttggaacggcctaccctgtagcgccttaccctggaacggcctaccctgtaacggctgccggtggactaccaaactcttgttattatattgtaatctgagcgtcttattttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtgttgggagcctactgcttttgctagcggtagctcctgaaatacaacggcggatctgcgatatcctctgagcgtagtaatttttatctcgcttttgactggagttgcagcgtctttagccgctaaaccccccaatttttaatggttgacctcggatcaggtaggaatacccgctgaacttaagcatatcaataagccggaggaa

We claim:

1. A synthetic composition comprising a designed complex endophyte and an agronomic formulation, the designed complex endophyte comprising a host fungal endophyte comprising a heterologous bacterial endophyte living inside the host fungal hyphae, wherein the designed complex endophyte provides a trait of agronomic importance to an agricultural plant element to which the synthetic composition is applied or to an agricultural plant grown from said agricultural plant element or of which said agricultural plant element is a part.

2. The synthetic composition of claim 1, wherein said trait of agronomic importance is selected from the group consisting of: germination rate, emergence rate, shoot biomass, root biomass, seedling root length, seedling shoot length, and yield.

3. The synthetic composition of claim 1, wherein the trait of agronomic importance is improved under normal watering conditions.

4. The synthetic composition of claim 1, wherein the trait of agronomic importance is improved under conditions of water limitation.

5. The synthetic composition of claim 1, wherein said agronomic formulation comprises one or more of the following: a stabilizer, or a preservative, or a carrier, or a surfactant, or an anticomplex agent, fungicide, nematicide, bactericide, insecticide, and herbicide, or any combination thereof.

6. A plant element coated with the synthetic composition of claim 1, wherein said designed complex endophyte is present in an amount of at least 10^2 CFU of designed complex endophyte per plant element.

7. The synthetic composition of claim 1, wherein said host fungal endophyte is from a class selected from the group consisting of: Dothideomycetes, Sordariomycetes, Mucoromycotina, Pezizomycotina, and any of the corresponding anamorphs or teleomorphs.

8. The synthetic composition of claim 1, wherein said heterologous bacterial endophyte is from a class selected from the group consisting of: Bacilli, Gammaproteobacteria, and Actinobacteria.

9. The synthetic composition of claim 1, wherein the host fungal endophyte comprises an internal transcribed spacer (ITS) nucleic acid sequence at least 95% identical to a nucleic acid sequence selected from the group consisting of SEQ ID NO: 561 through SEQ ID NO: 758.

10. The synthetic composition of claim 1, wherein the heterologous bacterial endophyte comprises a 16S rDNA nucleic acid sequence at least 95% identical to a nucleic acid sequence selected from the group consisting of SEQ ID NO: 1 through SEQ ID NO: 560.

11. The synthetic composition of claim 1, wherein said designed complex endophyte is selected from the designed complex endophytes listed in Table 3.

12. A plurality of the coated plant elements of claim 6, placed in a medium that promotes plant growth, wherein said medium is soil, wherein said coated plant elements are placed in the soil with substantially equal spacing between each.

13. A plant, plant element, or progeny of the plant grown from a seed contacted with the synthetic composition of claim 1, wherein said plant or progeny of the plant comprises in at least one of its plant elements said designed complex endophyte, or wherein said plant element comprises said designed complex endophyte.

14. A method of inoculating a plant with the designed complex endophyte of claim 1, comprising contacting a plant element of said plant with the synthetic composition of claim 1 and incubating said contacted plant element to allow the synthetic composition to colonize one or more tissues of said plant.

15. A method of improving a trait of agronomic importance in a plant, comprising:
  (a) contacting a plant element of the plant with the synthetic composition of claim 1; and
  (b) growing the plant element comprising the synthetic composition into the plant, wherein the plant grown from the contacted plant element has an improvement in the trait of agronomic importance as compared to an isoline plant not contacted with the synthetic composition of claim 1.

16. A method of improving a trait of agronomic importance in a plant, comprising growing said plant from a plant reproductive element that has been contacted with the synthetic composition of claim 1; wherein the plant grown from the contacted reproductive element comprises the synthetic composition of claim 1, and wherein the plant grown from the contacted plant reproductive element has an improvement in a trait of agronomic importance as compared to an isoline plant grown from a plant reproductive element not contacted with the synthetic composition of claim 1.

17. The synthetic composition of claim 7, wherein said designed complex endophyte comprises a host fungal endophyte of the class Mucoromycotina.

18. The synthetic composition of claim 17, wherein said designed complex endophyte comprises a host fungal endophyte of the genus *Mucor*.

19. The synthetic composition of claim 8, wherein said designed complex endophyte comprises a heterologous bacterial endophyte of the class Bacilli.

20. The synthetic composition of claim 19, wherein said designed complex endophyte comprises a heterologous bacterial endophyte of the genus *Paenibacillus*.

21. The synthetic composition of claim 9, wherein the host fungal endophyte comprises an internal transcribed spacer (ITS) nucleic acid sequence at least 95% identical to SEQ ID NO: 756.

22. The synthetic composition of claim 9, wherein the host fungal endophyte comprises an internal transcribed spacer (ITS) nucleic acid sequence at least 97% identical to SEQ ID NO: 756.

23. The synthetic composition of claim 10, wherein the heterologous bacterial endophyte comprises a 16S nucleic acid sequence at least 95% identical to SEQ ID NO: 13.

24. The synthetic composition of claim 10, wherein the heterologous bacterial endophyte comprises a 16S nucleic acid sequence at least 97% identical to SEQ ID NO: 13.

25. The synthetic composition of claim 11, wherein said designed complex endophyte comprises a host fungal endophyte of the genus *Mucor* and a heterologous bacterial endophyte of the genus *Paenibacillus*.

26. The synthetic composition of claim 1, wherein the host fungal endophyte comprises an internal transcribed spacer (ITS) nucleic acid sequence selected from the group consisting of SEQ ID NO: 561 through SEQ ID NO: 758.

27. The synthetic composition of claim 1, wherein the heterologous bacterial endophyte comprises a 16S rDNA nucleic acid sequence selected from the group consisting of SEQ ID NO: 1 through SEQ ID NO: 560.

28. The synthetic composition of claim 1, wherein the host fungal endophyte is of the genus *Mucor* and comprises an internal transcribed spacer (ITS) nucleic acid sequence comprising SEQ ID NO: 756.

29. The synthetic composition of claim 1, wherein the heterologous bacterial endophyte is of the genus *Paenibacillus* and comprises a 16S nucleic acid sequence comprising SEQ ID NO: 13.

30. The synthetic composition of claim 1, wherein the host fungal endophyte is of the genus *Mucor* and comprises an internal transcribed spacer (ITS) nucleic acid sequence comprising SEQ ID NO: 756 and the heterologous bacterial endophyte is of the genus *Paenibacillus* and comprises a 16S nucleic acid sequence comprising SEQ ID NO: 13.

31. A method of creating the designed complex endophyte of claim 1 comprising at least one host fungus comprising a heterologous bacterium living inside the host fungal hyphae, the method comprising:
  a. isolating and purifying a bacterium;
  b. isolating and purifying a fungus;
  c. co-culturing said bacterium with said fungus in a liquid medium; and
  d. incubating the co-cultured bacterium and fungus at a temperature not exceeding 35.5 degrees Celsius.

32. The method of claim 31 wherein step a) is conducted at a temperature range selected from the group consisting of: between 18° C. and 36° C., between 20° C. and 30° C., between 20° C. and 26° C., between 20.0° C. and 25.5° C., between 22.0° C. and 25.0° C., and between 23.0° C. and 24.0° C.

33. The method of claim 31, further comprising, after step b): treating said fungus with one or more antibiotics to rid the fungus of any bacteria that are not the heterologous bacterium.

34. The method of claim 31, further comprising plating the co-cultures on 2% water agar for a minimum of 1 week, then transferring said co-culture to full-strength PDA/LB agar.

35. The method of claim 31, wherein the co-cultured bacterium and fungus are incubated at a temperature range selected from the group consisting of: between 18° C. and 36° C., between 20° C. and 30° C., between 20° C. and 26° C., between 20.0° C. and 25.5° C., between 22.0° C. and 25.0° C., and between 23.0° C. and 24.0° C.

36. The method of claim 31, wherein the incubated co-cultured bacterium and fungus are further treated with gentamicin.

37. The method of claim 31, wherein the co-cultured bacterium and fungus are further grown in broth comprising gentamicin and/or plated onto agar comprising gentamicin.

38. The method of claim 36, wherein the cultures are washed with a solution comprising magnesium chloride no fewer than three times.

39. The method of claim 36, wherein the concentration of gentamicin is selected from the group consisting of: 5 micrograms per mL, 20 micrograms per mL, 50 micrograms per mL, and 75 micrograms per mL.

\* \* \* \* \*